US008241643B2

(12) United States Patent
Meinke et al.

(10) Patent No.: US 8,241,643 B2
(45) Date of Patent: Aug. 14, 2012

(54) **PEPTIDES PROTECTIVE AGAINST *S. PNEUMONIAE* AND COMPOSITIONS, METHODS AND USES RELATING THERETO**

(75) Inventors: Andreas Meinke, Pressbaum (AT); Astrid Teubenbacher, Vienna (AT); Beatrice Senn, Vienna (AT); Manuel Zerbs, Vienna (AT); Markus Hanner, Pressbaum (AT); Jutta Pikalo, Strau (AT); Eszter Nagy, Vienna (AT); Carmen Giefing-Kröll, Vienna (AT); Alexander Von Gabain, Vienna (AT)

(73) Assignee: Intercell AG, Vienna (AT)

( * ) Notice: Subject to any disclaimer, the term of this patent is extended or adjusted under 35 U.S.C. 154(b) by 7 days.

(21) Appl. No.: 12/933,020

(22) PCT Filed: Mar. 17, 2009

(86) PCT No.: PCT/EP2009/053119
§ 371 (c)(1),
(2), (4) Date: Dec. 10, 2010

(87) PCT Pub. No.: WO2009/115508
PCT Pub. Date: Sep. 24, 2009

(65) Prior Publication Data
US 2011/0091494 A1  Apr. 21, 2011

(30) Foreign Application Priority Data

Mar. 17, 2008 (EP) .................................. 08102655

(51) Int. Cl.
A61K 39/09 (2006.01)
C07K 14/315 (2006.01)
(52) U.S. Cl. .................. 424/244.1; 424/190.1; 530/350
(58) Field of Classification Search ........................ None
See application file for complete search history.

(56) References Cited

U.S. PATENT DOCUMENTS

| 4,946,778 | A | 8/1990 | Ladner et al. |
| 5,854,416 | A | 12/1998 | Sampson et al. |
| 7,115,731 | B1 * | 10/2006 | Doucette-Stamm et al. ... 536/23.7 |
| 7,635,487 | B2 * | 12/2009 | Meinke et al. .............. 424/244.1 |

FOREIGN PATENT DOCUMENTS

| GB | 2188638 A | 10/1987 |
| WO | WO 86/01533 | 3/1986 |
| WO | WO 90/07861 | 7/1990 |
| WO | WO 91/18088 | 11/1991 |
| WO | WO 96/02555 | 2/1996 |
| WO | WO 00/06738 A2 | 2/2000 |
| WO | WO 01/24822 A2 | 4/2001 |
| WO | WO 01/54720 A1 | 8/2001 |
| WO | WO 01/78767 A1 | 10/2001 |
| WO | WO 01/93903 A1 | 12/2001 |
| WO | WO 01/93905 A1 | 12/2001 |
| WO | WO 02/13857 A2 | 2/2002 |
| WO | WO 02/32451 A1 | 4/2002 |
| WO | WO 02/059148 A2 | 8/2002 |
| WO | WO 02/077021 A2 | 10/2002 |
| WO | WO 02/095027 A2 | 11/2002 |
| WO | WO 03/047602 A1 | 6/2003 |
| WO | WO 2004/092209 A2 | 10/2004 |
| WO | WO 2008/061953 A1 | 5/2008 |
| WO | WO 2009/016515 A2 | 2/2009 |

OTHER PUBLICATIONS

Adamou et al., "Identification and Characterization of a Novel Family of Pneumococcal Proteins that are Protective Against Sepsis," (2001); *Infect. Immun.* 69: 949-58.
Altschul et al., "Basic Local Alignment Search Tool," (1990), *J. Mol. Biol.* 215: 403-10.
Amit et al., "Three-Dimensional Structure of an Antigen-Antibody Complex at 2.8 Å Resolution," (1986), *Science* 233: 747-53.
Burnie, J., et al., "The Renaissance of Antibody Therapy," (1998), *J. Antimicrob. Chemother.* 41: 319-22.
Carter et al., "Improved Oligonucleotide Site-Directed Mutagenesis using M13 Vectors," (1985), *Nucl. Acids Res.* 13: 4431-43.
Cohen, "Naked DNA Points Way to Vaccines," (1993), *Science* 259: 1691-2.
Di Guilmi et al., "New Approaches Towards the Identification of Antibiotic and Vaccine Targets in *Streptococcus pneumoniae*," (2002); *EMBO Reports* 3: 728-34.
GenBank accession No. AAE22907, dated Sep. 29, 1999.
GenBank accession No. AE005672, dated Jan. 26, 2006.
GenBank accession No. AE007317, dated Nov. 25, 2002.
GenBank accession No. AR069091, dated Sep. 29, 1999.
GenBank accession No. CP000410, dated Dec. 18, 2006.
Giefing et al., "Discovery of a Novel Class of Highly Conserved Vaccine Antigens Using Genomic Scale Antigenic Fingerprinting of Pneumococcus with Human Antibodies" *The Journal of Experimental Medicine*, (2008) 205(1): 117-131.
Hoskins et al., "Genome of the Bacterium *Streptococcus pneumoniae* Strain R6," (2001), *Journal of Bacteriology* 183: 5709-17.
Huse et al., "Generation of a Large Combinatorial Library of the Immunoglobulin Repertoire in Phase Lambda," (1988), *Science* 246: 1275-81.
Hyde et al. (2001), "Macrolide Resistance Among Invasive *Streptococcus pneumoniae* Isolates," *JAMA* 286: 1857-62.

(Continued)

Primary Examiner — Padma Baskar
(74) Attorney, Agent, or Firm — Wolf, Greenfield & Sacks, P.C.

(57) ABSTRACT

The present invention relates to a protective peptide of *Streptococcus pneumoniae* (*S. pneumoniae*) or a functionally active variant thereof; a composition comprising at least two of such peptides or variants; one or more nucleic acid(s) encoding such peptide or variant; a pharmaceutical composition comprising such peptide or variant, composition, or nucleic acid(s); a method of producing an antibody using such peptide or variant or composition; the use of such peptide or variant and/or composition and/or nucleic acid(s) for the manufacture of a medicament; a method of diagnosing a *S. pneumoniae* infection using such peptide or variant, composition or a primer and/or probe specific for the nucleic acid(s); a method for identifying a ligand capable of binding to such peptide or variant; and the use of such peptide or variant for the isolation, purification and/or identification of an interaction partner of the peptide.

17 Claims, 12 Drawing Sheets

OTHER PUBLICATIONS

Figure 1:
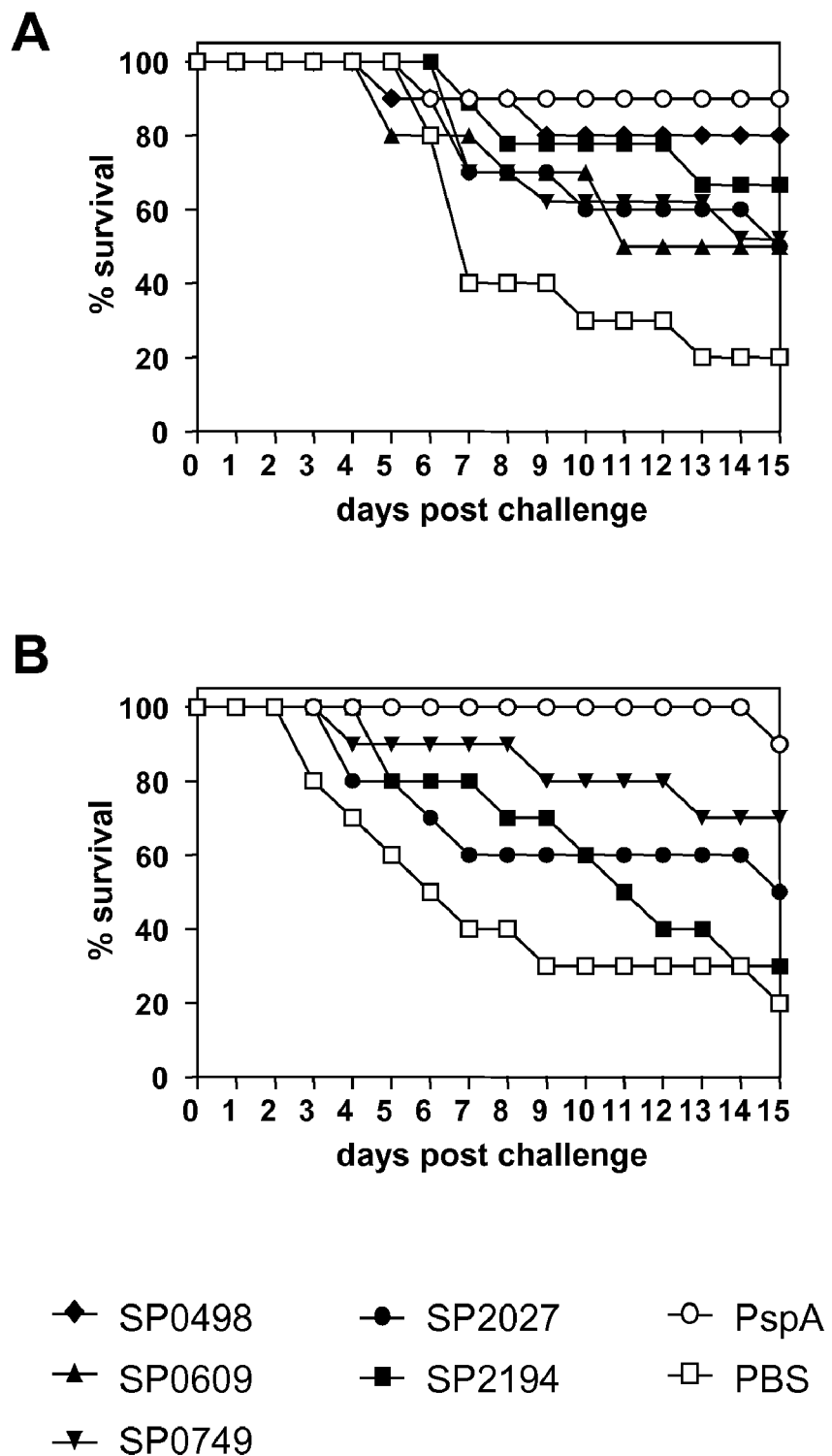

International Search Report for International Patent Application No. PCT/EP2009/053119, dated Sep. 4, 2009.

Ishibashi et al., "Hypercholesterolemia in Low-Density Lipoprotein Receptor Knockout Mice and its Reversal by Adenovirus-Mediated Gene Delivery," (1993), *J. Clin. Invest.* 92: 883-93.

Jedrzejas, "Pneumococcal Virulence Factors: Structure and Function," (2001); *Microbiol. Mol. Biol. Rev.* 65: 187-207.

Kay et al., "In Vivo Hepatic Gene Therapy: Complete Albeit Transient Correction of Factor IX Deficiency in Hemophilia B Dogs," (1994), *Proc. Natl. Acad. Sci. USA* 91: 2353-57.

McCormick et al., "Geographic Diversity and Temporal Trends of Antimicrobial Resistance in *Streptococcus pneumonia* in the United States," (2003), *Nat. Med.* 9: 424-30.

McDaniel et al., "PspA, A Surface Protein of *Streptococcus pneumonia*, is Capable of Eliciting Protection Against Pneumococci of More Than One Capsular Type," (1991), *Infect. Immun.* 59: 222-8.

Navarre et al., "Surface Proteins of Gram-Positive Bacteria and Mechanisms of their Targeting to the Cell Wall Envelope," (1999), *Microbiol. Mol. Biol. Rev.* 63: 174-229.

Pearson and Lipman, "Improved Tools for Biological Sequence Comparison," (1988), *Proc. Natl. Acad. Sci. U.S.A.* 85: 2444-48.

Pelton et al., "Pneumococcal Conjugate Vaccines: Proceedings from an Interactive Symposium at the 41$^{st}$ Interscience Conference on Antimicrobial Agents and Chemotherapy," (2003), *Vaccine* 21: 1562-71.

Queen et al., "A Humanized Antibody that Binds to the Interleukin 2 Receptor," (1989), *Proc. Natl. Acad. Sci. USA* 86: 10029-33.

Rammensee et al., "SYFPEITHI: A Database for MHC Ligands and Peptide Motifs," (1999), *Immunogenetics.* 50: 213-19.

Ren et al., "Both Family 1 and Family 2 PspA Proteins Can Inhibit Complement Deposition and Confer Virulence to a Capsular Serotype 3 Strain of *Streptococcus pneumoniae*," (2003), *Infect. Immun.* 71: 75-85.

Riechmann et al., "Reshaping Human Antibodies for Therapy," (1988), *Nature* 332: 323-7.

Roche et al., "Regions of PspA/EF3296 Best Able to Elicit Protection Against *Streptococcus pneumonia* in a Murine Infection Model," (2003), *Infect. Immun.* 71: 1033-41.

Rosenow et al., "Contribution of Novel Choline-Binding Proteins to Adherence, Colonization and Immunogenicity of *Streptococcus pneumonia*," (1997); *Mol. Microbiol.* 25: 819-29.

Smith and Waterman, "Comparison of Biosequences," (1981), *Adv. Appl. Math.* 2: 482-9.

"*Streptococcus penumoniae TIGR4* Genome Page," J. Craig Venter Institute, http://cmr.tigr.org/tigr-scripts/CMR/GenomePage.cgi?org=bsp, dated Jul. 20, 2001.

"*Streptococcus penumoniae R6* Genome Page," Eli Lilly, http://cmr.tigr.org/tigr-scripts/CMR/GenomePage.cgi?org=ntsp02, dated Oct. 12, 2001.

"*Streptococcus penumoniae G54* Genome Page," J. Craig Venter Institute, http://cmr.tigr.org/tigr-scripts/CMR/GenomePage.cgi?org=ntsp05, dated Jan. 18, 2006.

Talkington et al., "Protection of mice Against Fatal Pneumococcal Challenge by Immunization with Pneumococcal Adhesin A (PsaA)," (1996), *Microb, Pathog,* 21: 17-22.

Tettelin et al., "Complete Genome Sequence of a Virulent Isolate of *Streptococcus pneumoniae*," (2001), *Science* 293: 498-506.

Wells et al., "Cassette Mutagenesis: An Efficient Method for Generation of Multiple Mutation at Defined Sites," (1985), *Gene,* 34: 315-23.

Wells et al., "Importance of Hydrogen-Bond Formation in Stabilizing the Transition State of Subtilisin," (1986), *Philos. Trans. R. Soc. London Ser A* 317: 415-23.

Whitney et al., "Increasing Prevalence of Multidrug-Resistant *Streptococcus pneumoniae* in the United States," (2000), *N. Engl. J. Med.* 343: 1917-24.

Wizemann, T., et al., "Use of a Whole Genome Approach to Identify Vaccine Molecules Affording Protection Against *Streptococcus pneumoniae* Infection," (2001); *Infect. Immun.* 69: 1593-8.

Zoller et al., "Oligonucleotide-Directed Mutagenesis using M13-Derived Vectors: An Efficient and General Procedure for the Production of Point Mutations in any Fragment of DNA," (1987), *Nucl. Acids Res.* 10: 6487-6500.

\* cited by examiner

PEPTIDES PROTECTIVE AGAINST S. PNEUMONIAE AND COMPOSITIONS, METHODS AND USES RELATING THERETO

CROSS REFERENCE TO RELATED APPLICATIONS

This application is the U.S. National Stage of International Application No. PCT/EP2009/053119, filed Mar. 17, 2009, which claims the benefit of European Patent Application No. 08102655.1, filed Mar. 17, 2008, each of which is hereby incorporated by reference.

The present invention relates to a protective peptide of Streptococcus pneumoniae (S. pneumoniae) or a functionally active variant of the protective peptide; a composition comprising at least two protective peptides or functionally active variants thereof; a composition comprising at least two proteins selected from the group consisting of i) a first type of protective peptide or functionally active variant thereof, ii) a second type of protective peptide or functionally active variant thereof and iii) a supportive peptide or a functionally active variant thereof; one or more nucleic acid(s) encoding the protective peptide or functionally active variant thereof or the at least two proteins comprised in the composition; a pharmaceutical composition comprising the protective peptide or functionally active variant thereof, the composition, or the nucleic acid(s); a method of producing an antibody using the protective peptide or functionally active variant thereof or the composition; the use of the protective peptide or functionally active variant thereof and/or the composition and/or the nucleic acid(s) for the manufacture of a medicament for the immunization or treatment of a subject; a method of diagnosing a S. pneumoniae infection using the protective peptide or a functionally active variant thereof, the composition or a primer and/or probe specific for the nucleic acid(s); a method for identifying a ligand capable of binding to a protective peptide or functionally active variant thereof; and the use of a protective peptide or functionally active variant thereof for the isolation and/or purification and/or identification of an interaction partner of the peptide.

Streptococcus pneumoniae (Pneumococcus) is a lancet-shaped, gram-positive, facultative anaerobic bacterium. It is only the encapsulated organism that is pathogenic for humans and experimental animals. Capsules are antigenic and form the basis for classifying pneumococci by serotypes. Ninety serotypes have been identified, based on their reaction with type-specific antisera. The genome of S. pneumoniae contains app. 2.16 Mb. It has an average GC content of 39.7%. S. pneumoniae is a strictly human pathogen. The complete genome sequence of a capsular serotype 4 isolate of S. pneumoniae, designated TIGR4 (referred to in this application as TIGR4_Tettelin), was determined by the random shotgun sequencing strategy (GenBank accession number AE005672). This clinical isolate was taken from the blood of a 30-year-old male patient in Kongsvinger, Norway, and is highly invasive and virulent in a mouse model of infection.

Most S. pneumoniae serotypes have been shown to cause serious disease, and the ten most common serotypes are estimated to account for about 62% of invasive disease worldwide. The ranking and serotype prevalence differs by age group and geographic area.

Pneumococci are common inhabitants of the respiratory tract, and may be isolated from the nasopharynx of 5% to 70% of normal adults. Rates of asymptomatic carriage vary with age, environment, and the presence of upper respiratory infections. Only 5%-10% of adults without children are carriers. In schools and orphanages, 27% to 58% of students and residents may be carriers. On military installations, as many as 50% to 60% of service personnel may be carriers. The duration of carriage varies and is generally longer in children than adults (reviewed in Epidemiology and Prevention of Vaccine-Preventable Diseases, 7th Edition-Second Printing, The Pink Book).

The relationship of carriage to the development of natural immunity as well as the immunologic mechanism that allows disease to occur in a carrier are poorly understood.

Streptococcus pneumoniae is an important agent of human disease at the extremities of age and in those who have underlying disease. Pneumococcal disease kills more people—in the US 40,000 or more each year—than all other vaccine preventable diseases combined. The major clinical syndromes of pneumococcal disease include pneumonia, bacteremia, and meningitis. The disease most often occurs when a predisposing condition exists, particularly pulmonary disease. It is a common bacterial complication of antecedent viral respiratory infection such as influenza and measles, and of chronic conditions such as chronic obstructive pulmonary disease, diabetes, congestive heart failure, renal failure, smoking and alcoholism. Pneumococcal infections are more common during the winter and in early spring when respiratory diseases are more prevalent. Immunodeficiency (splenic dysfunction, iatrogen, etc.) is a risk factor for development of fatal pneumococcal infections, because of decreased bacterial clearance and lack of antibodies. The incubation period is short, 1-3 days. Symptoms include an abrupt onset of fever and shaking chills or rigor, productive cough, pleuritic chest pain, dyspnoe, tachycardia and hypoxia.

S. pneumoniae is responsible for 88% of bacteremia infections in the US. Pneumonia is the most common form of invasive pneumococcal diseases: 150,000-570,000 cases per year (US). 36% of adult community-acquired and 50% of hospital-acquired pneumonia is caused by S. pneumoniae (US). The incidence of disease among adults aged 65 years and older has been reported to be ~60 cases/100,000. Case fatality rates for this disease increase from 1.4% for those aged two or younger to as high as 20.6% among those aged 80 or older. Diseases caused by influenza and Pneumococcus are together the fifth leading cause of death for persons aged 65 and older. Mortality attributable to these pathogens is more than 90% in this age group. Bacteremia occurs in about 25-30% of patients with pneumonia. The overall mortality rate of bacteremia is about 20%, but may be as high as 60% in elderly people. In 1998, 51% of all deaths attributable to invasive pneumococcal diseases occurred in age group above 65 years. Pneumococci cause 13%-19% of all cases of bacterial meningitis in the United States. An estimated 3,000 to 6,000 cases of pneumococcal meningitis occur each year. One-quarter of patients with pneumococcal meningitis also have pneumonia. The clinical symptoms, spinal fluid profile and neurologic complications are similar to other forms of purulent bacterial meningitis (reviewed in Epidemiology and Prevention of Vaccine-Preventable Diseases, 7th Edition-Second Printing, The Pink Book).

In children, Pneumococci are a common cause of acute otitis media, and are detected in 28%-55% of middle ear aspirates. By age 12 months, 62% of children have had at least one episode of acute otitis media. Middle ear infections are the most frequent reasons for pediatric office visits in the United States, resulting in over 20 million visits annually. Complications of pneumococcal otitis media may include mastoiditis and meningitis. Bacteremia without a known site of infection is the most common invasive clinical presentation among children <2 years of age, accounting for approximately 70% of invasive disease in this age group. Bacteremic pneumonia accounts for 12%-16% of invasive pneumococcal disease among children <2 years of age. With the decline of invasive Hib disease, *S. pneumoniae* has become the leading cause of bacterial meningitis among children <5 years of age in the United States. Children <1 year have the highest rates of pneumococcal meningitis, approximately 10 cases per 100, 000 population. The burden of pneumococcal disease among children <5 years of age is significant. An estimated 17,000 cases of invasive disease occur each year, of which 13,000 are bacteremia without a known site of infection and about 700 are meningitis. An estimated 200 children die every year as a result of invasive pneumococcal disease. Although not considered invasive disease, an estimated 5 million cases of acute otitis media occur each year among children <5 years of age (reviewed Epidemiology and Prevention of Vaccine-Preventable Diseases, 7th Edition-Second Printing, The Pink Book).

A definitive diagnosis of infection with *Streptococcus pneumoniae* generally relies on isolation of the organism from blood or other normally sterile body sites. Tests are also available to detect capsular polysaccharide antigen in body fluids.

Penicillin is the drug of choice for treatment. However, successful implementation of anti-infective therapy has become increasingly difficult because of widespread antimicrobial resistance. Resistance to penicillin is rising, and according to recent reports it reaches 25% in the US (Whitney, C., et al. (2000), N Engl J Med 343: 1917-24). The proportion of macrolide-resistant strains reached ~20% (Hyde, T., et al. (2001), JAMA 286: 1857-62). Use of antimicrobial agents is highly correlated with the increase in resistance of *S. pneumoniae* to β-lactams and macrolides (McCormick, A., et al. (2003), Nat Med 9: 424-30).

However, even with effective antibiotic therapy (sensitive strains), the case fatality rate of invasive disease is high with an average of 10% in the developed world and can be much higher with certain serotypes, in elderly patients and in cases of bacteremia or meningitis (up to 80%).

Thus, there remains a need for an effective treatment to prevent or ameliorate pneumococcal infections. A vaccine could not only prevent infections by streptococci, but more specifically prevent or ameliorate colonization of host tissues (esp. in nasopharynx), thereby reducing the incidence of upper respiratory infections and other suppurative infections, such as otitis media. Elimination of invasive diseases—pneumonia, bacteremia and meningitis, and sepsis—would be a direct consequence of reducing the incidence of acute infection and carriage of the organism. Vaccines capable of showing cross-protection against the majority of *S. pneumoniae* strains causing human infections would also be useful to prevent or ameliorate infections caused by all other streptococcal species, namely groups A, B, C and G.

A vaccine can contain a whole variety of different antigens. Examples of antigens are whole-killed or attenuated organisms, subfractions of these organisms/tissues, proteins, or, in their most simple form, peptides. Antigens can also be recognized by the immune system in form of glycosylated proteins or peptides and may also be or contain polysaccharides or lipids. Short peptides can be used since for example cytotoxic T-cells (CTL) recognize antigens in form of short, usually 8-11 amino acids long peptides in conjunction with major histocompatibility complex (MHC). B-cells can recognize linear epitopes as short as 4-5 amino acids, as well as three-dimensional structures (conformational epitopes). In some circumstances adjuvants may be useful for sustaining antigen-specific immune responses. Primarily, adjuvants are acting, but are not restricted in their mode of action, on so-called antigen presenting cells (APCs). These cells usually first encounter the antigen(s) followed by presentation of processed or unmodified antigen to immune effector cells. Intermediate cell types may also be involved. Only effector cells with the appropriate specificity are activated in a productive immune response. The adjuvant may also locally retain antigens and co-injected other factors. In addition the adjuvant may act as a chemoattractant for other immune cells or may act locally and/or systemically as a stimulating agent for the immune system.

Efforts to develop effective pneumococcal vaccines began as early as 1911. However, with the advent of penicillin in the 1940s, interest in the vaccine declined, until it was observed that many patients still died despite antibiotic treatment. By the late 60s, efforts were again being made to develop a polyvalent vaccine. The first pneumococcal vaccines contained purified capsular polysaccharide antigen from 14 different types of pneumococcal bacteria. In 1983, a 23-valent polysaccharide vaccine (PPV23) was licensed and replaced the 14-valent vaccine, which is no longer produced. PPV23 contains polysaccharide antigen from 23 types of pneumococcal bacteria which cause 88% of bacteremic pneumococcal disease. In addition, cross-reactivity occurs for several capsular types which account for an additional 8% of bacteremic disease. Two polysaccharide vaccines are available in the United States (Pneumovax 23, Merck, and Pnu-Immune 23, Wyeth-Lederle). Both vaccines contain 25 µg of each antigen per dose and include either phenol or thimerosal as a preservative.

The first pneumococcal conjugate vaccine (PCV7, Prevnar) was licensed in the United States in 2000. It includes purified capsular polysaccharide of 7 serotypes of *S. pneumoniae* (4, 9V, 14, 19F, 23F, 18C, and 6B) conjugated to a nontoxic variant of diphtheria toxin known as CRM197. The serotypes included in Prevnar accounted for 86% of bacteremia, 83% of meningitis, and 65% of acute otitis media among children <6 years of age in the United States during 1978-1994 (reviewed in Epidemiology and Prevention of Vaccine-Preventable Diseases, 7th Edition-Second Printing, The Pink Book). Additional pneumococcal polysaccharide conjugate vaccines containing 9 and 11 serotypes of *S. pneumoniae* are being developed. The vaccine is administered intramuscularly. After 4 doses of Prevnar vaccine, virtually all healthy infants develop antibody to all 7 serotypes contained in the vaccine. Prevnar has also been shown to be immunogenic in infants and children, including those with sickle cell disease and HIV infection. In a large clinical trial, Prevnar was shown to reduce invasive disease caused by vaccine serotypes, and reduce invasive disease caused by all serotypes, including serotypes not in the vaccine. Children who received Prevnar had fewer episodes of acute otitis media and underwent fewer tympanostomy tube placements than unvaccinated children. The duration of protection following Prevnar is currently unknown. Immunization with Prevnar reduces the rate of nasopharyngeal carriage of the vaccine serotypes, while the overall carriage rate is unaffected. Unfortunately, it has also been shown to induce serotype redistribution, that is the replacement of vaccine serotypes by strains, which are not covered by Prevnar (Pelton, S., et al. (2003), Vaccine 21: 1562-71).

Pneumococcal vaccine is recommended to be administered routinely to i., all children as part of the routine childhood immunization schedule, ii., adults 65 years of age and older and iii., persons aged >2 years with normal immune systems who have chronic illnesses, including cardiovascular disease, pulmonary disease, diabetes, alcoholism, cirrhosis, or cerebrospinal fluid leaks. In the elderly population the target groups for pneumococcal vaccine and influenza vaccine overlap. These vaccines can be given at the same time at different sites without increased side effects.

High mortality is observed among high-risk individuals (with underlying disease—mainly viral respiratory infection, immunocompromised) even with effective antibiotic therapy. The mAb approach targets patients with serious disease and provides immediate immune enhancement for the clearance of the bacteria. Through opsonization bacteria are killed within phagocytic cells and not lysed in the blood by antibiotics. This mechanism of action can help to eliminate the release of toxins (such as pneumolysin and other cytotoxins), which worsen the clinical condition of septic patients. Recent advances in the technology of monoclonal antibody production provide the means to generate human antibody reagents and reintroduce antibody therapies, while avoiding the toxicities associated with serum therapy. Immunoglobulins are an extremely versatile class of antimicrobial proteins that can be used to prevent and treat emerging infectious diseases. Antibody therapy has been effective against a variety of diverse microorganisms reviewed in (Burnie, J., et al. (1998), J Antimicrob Chemother 41: 319-22).

Although capsular specific antibodies have been shown to be highly protective, it remains unclear what concentration of these serotype-specific antibodies protect against disease and more recently it has become clear that opsonic activity and avidity of these antibodies are more critical determinants of protection than concentration.

Protein conjugate vaccines are no doubt a great new addition to the amarmatorium in the battle against pneumococcal disease, but the vaccine contains a limited number of pneumococcal serotypes and given adequate ecological pressure, replacement disease by non-vaccine serotypes remains a real threat, particularly in areas with very high disease burden.

During the last decade the immunogenicity and protective capacity of several pneumococcal proteins have been described in animal models and these are now being explored for the development of species-common protein based vaccines. Such proteins are the Pneumococcal surface protein A (PspA, McDaniel, L., et al. (1991), Infect Immun 59: 222-8; Roche, H., et al. (2003), Infect Immun 71: 1033-41), Pneumococcal surface adhesin A (PsaA, Talkington, D., et al. (1996), Microb Pathog 21: 17-22), Choline binding protein A (CbpA, Rosenow, C., et al. (1997); Mol Microbiol 25: 819-29), LytB glucosaminidase, LytC muramidase, PrtA serine protease, PhtA (histidine triad A) and Pneumococcal vaccine antigen A (PvaA) Wizemann, T., et al. (2001); Infect Immun 69: 1593-8; Adamou, J., et al. (2001); Infect Immun 69: 949-58).

Certain proteins or enzymes displayed on the surface of gram-positive organisms significantly contribute to pathogenesis, and might be involved in the disease process caused by these pathogens. Often, these proteins are involved in direct interactions with host tissues or in concealing the bacterial surface from the host defense mechanisms (Navarre, W., et al. (1999); Microbiol Mol Biol Rev 63: 174-229). *S. pneumoniae* is not an exception in this regard. Several surface proteins are characterized as virulence factors, important for pneumococcal pathogenicity as reviewed in Jedrzejas, M. (2001); Microbiol Mol Biol Rev 65: 187-207. If antibodies to these proteins could offer better protection to humans, they could provide the source of a novel, protein-based pneumococcal vaccine to be used in conjunction with or in place of the more traditional capsular polysaccharide vaccine. The use of some of the above-described proteins as antigens for a potential vaccine as well as a number of additional candidates reviewed in Di Guilmi, A., et al. (2002); EMBO Rep 3: 728-34 resulted mainly from a selection based on easiness of identification or chance of availability. In order to meet the demand to identify relevant antigens for *S. pneumoniae* in a more comprehensive way methods for identification, isolation and production of hyperimmune serum reactive antigens from a specific pathogen, especially from *Staphylococcus aureus* and *Staphylococcus epidermidis* (WO 02/059148) have been developed. Additionally, methods for identification of reactive antigens as well as reactive antigens of *Streptococcus pneumoniae* have been provided (WO 04/092209).

The problem underlying the present invention was to provide alternative means for the development of medicaments such as vaccines against *S. pneumoniae* infection. More particularly, the problem was to provide an alternative protective peptide or combinations thereof, particularly more effective proteins or combinations thereof, from *S. pneumoniae* that can be used for the manufacture of said medicaments.

Surprisingly, the object has been solved by one or more peptides consisting of the amino acid sequence of
  SEQ ID NO:1, SEQ ID NO:2, SEQ ID NO:3, SEQ ID NO:4, and/or SEQ ID NO:5; and
  optionally SEQ ID NO:6, SEQ ID NO:7, and/or SEQ ID NO:8.

However, a functionally active variant of these sequences may also be used in the context of the present invention.

Therefore, a first subject of the invention is a protective peptide consisting of the amino acid sequence of the SEQ ID NO:1, 2, 3, 4 or 5, or a functionally active variant of the protective peptide. These peptides (protective peptides of the amino acid sequence of the SEQ ID NO:1, 2, 3, 4 or 5, and functionally active variants thereof) are referred to as antigenic peptides of subgroup i).

The protective peptides consisting of the amino acid sequences of SEQ ID NO:1, 2, 3, 4 or 5 are derived from *S. pneumoniae* strain TIGR4_Tettelin (Tettelin et al. (2001), Science 293: 498-506) and have been denoted by SP0498, SP0609, SP0749, SP2027 and SP2194, respectively. The amino acid and DNA sequences of the full length proteins from which the protective peptides consisting of the amino acid sequences of SEQ ID NO:1, 2, 3, 4 and 5 are derived are disclosed in WO 04/092209.

The amino acid sequences of SEQ ID NO:1, 2, 3, 4 and 5 are disclosed in the Examples as well as in the attached Sequence Listing. The peptides of SEQ ID NO:1, 2, 3, 4 and 5 have been shown to induce a protective immune response against *S. pneumoniae* in a sepsis and/or pneumonia model (see Examples and Figures).

Functionally active variants may be obtained by changing the sequence of the protective peptide as defined below and are characterized by having a biological activity similar to that displayed by the protective peptide of the sequence of SEQ ID NO:1, 2, 3, 4 or 5 from which the variant is derived, including the ability to induce protective immune responses and/or to show protection against *S. pneumoniae* e.g. in a sepsis and/or pneumonia model, wherein any variant may be tested in any of the tests described in the Examples.

The functionally active variant of a protective peptide may be obtained by sequence alterations in the protective peptide, wherein the peptide with the sequence alterations retains a function of the unaltered protective peptide, e.g. having a biological activity similar to that displayed by the unaltered protective peptide (see above). Such sequence alterations can include, but are not limited to, (conservative) amino acid substitutions, deletions, mutations and insertions.

In a preferred embodiment of the invention the functionally active variant of the protective peptide consisting of the amino acid sequence of SEQ ID NO:1, 2, 3, 4 or 5 a) is a functionally active fragment of the protective peptide, the functionally active fragment comprising at least 75% of the sequence of the protective peptide, preferably at least 80%, more preferably at least 85%, still more preferably at least 90%, even more preferably at least 95% and most preferably at least 97%, 98% or 99%;
b) is derived from the protective peptide by at least one amino acid substitution and/or deletion, wherein the functionally active variant has a sequence identity to the protective peptide or to the functionally active fragment as defined in a) of at least 75%, preferably at least 80%, more preferably at least 85%, still more preferably at least 90%, even more preferably at least 95% and most preferably at least 97%, 98% or 99%; and/or
c) consists of the protective peptide or a functionally active variant thereof, preferably the variant of a) and/or b), and additionally at least one amino acid heterologous to the protective peptide.

The functionally active variant of the invention is characterized by having a biological activity similar to that displayed by the protective peptide, including the ability to induce protective immune responses and/or to show protection against *S. pneumoniae* e.g. in a sepsis and/or pneumonia model. The variant of the protective peptide is functionally active in the context of the present invention, if the activity of the variant amounts to at least 10%, preferably at least 25%, more preferably at least 50%, even more preferably at least 70%, still more preferably at least 80%, especially at least 90%, particularly at least 95%, most preferably at least 99% of the activity of the protective peptide without sequence alteration. The activity of the variant may be determined or measured as described in the Examples and then compared to that obtained for the protective peptide of the amino acid sequence of SEQ ID NO:1, 2, 3, 4 or 5.

The functionally active fragment of the protective peptide is characterized by being derived from the protective peptide of SEQ ID NO:1, 2, 3, 4 or 5 by one or more amino acid deletions resulting in a peptide comprising at least 75% of the sequence of the protective peptide, preferably at least 80%, more preferably at least 85%, still more preferably at least 90%, even more preferably at least 95% and most preferably at least 97%, 98% or 99%. Sequence identity may be determined as described below. The amino acid deletion(s) may be C-terminally, N-terminally and/or internally. Preferably the fragment is obtained by 1, 2, 3, 4, 5, 6, 7, 8, 9 or 10, more preferably 1, 2, 3, 4 or 5, even more preferably 1, 2 or 3, still more preferably 1 or 2, most preferably 1 amino acid deletion(s).

Alternatively or additionally the variant may be obtained from the protective peptide by at least one amino acid substitution and/or deletion, wherein the functionally active variant has a sequence identity to the protective peptide or to the functionally active fragment as defined in a) of at least 75%, preferably at least 80%, more preferably at least 85%, still more preferably at least 90%, even more preferably at least 95% and most preferably at least 97%, 98% or 99%. Sequence identity may be determined as described below. The amino acid substitution(s) and/or deletion(s) may be C-terminally, N-terminally and/or internally. Preferably the functionally active variant is obtained from the protective peptide or the fragment, preferably the protective peptide, by 1, 2, 3, 4, 5, 6, 7, 8, 9 or 10, more preferably 1, 2, 3, 4 or 5, even more preferably 1, 2 or 3, still more preferably 1 or 2, most preferably 1 amino acid substitution(s) and/or deletion(s).

Furthermore, the variant may consist of the protective peptide or the functionally active variant thereof, preferably the variant of a) and/or b), and at least one amino acid residue heterologous to the protective peptide or variant thereof, such as a marker protein. The feature "heterologous amino acid" or "amino acid heterologous to the protective peptide or variant thereof" refers to any amino acid which is different from that amino acid located adjacent to the protective protein in any naturally occurring protein of *S. pneumoniae*, particularly from that of *S. pneumoniae* strain TIGR4_Tettelin, especially the sequence made reference to above. Therefore, the protein of the invention encompassing at least one heterologous amino acid refers to a protein which is different from any naturally occurring protein of *S. pneumoniae*, particularly from that of *S. pneumoniae* strain TIGR4_Tettelin. The one or more additional amino acids may be C-terminally, N-terminally or C- and N-terminally to the protective peptide or variant thereof.

The following details are intended to refer to the protective peptides of subgroup i), the additional protective peptides as defined below as well as the supportive peptide as defined below and the variants of these:

The substituted or additional sequence or amino acid residue(s) as defined above consists of (an) amino acid residue(s), which may be any amino acid, which may be either an L- and/or a D-amino acid, naturally occurring and otherwise. Preferably the amino acid is any naturally occurring amino acid such as alanine, cysteine, aspartic acid, glutamic acid, phenylalanine, glycine, histidine, isoleucine, lysine, leucine, methionine, asparagine, proline, glutamine, arginine, serine, threonine, valine, tryptophan or tyrosine.

However, the amino acid residue(s) may also be (a) modified or (an) unusual amino acid(s). Examples of those are 2-aminoadipic acid, 3-aminoadipic acid, beta-alanine, 2-aminobutyric acid, 4-aminobutyric acid, 6-aminocaproic acid, 2-aminoheptanoic acid, 2-aminoisobutyric acid, 3-aminoisobutyric acid, 2-aminopimelic acid, 2,4-diaminobutyric acid, desmosine, 2,2'-diaminopimelic acid, 2,3-diaminopropionic acid, N-ethylglycine, N-ethylasparagine, hydroxylysine, allo-hydroxylysine, 3-hydroxyproline, 4-hydroxyproline, isodesmosine, allo-isoleucine, N-methylglycine, N-methylisoleucine, 6-N-methyllysine, N-methylvaline, norvaline, norleucine or ornithine. Additionally, the amino acid(s) may be subject to modifications such as posttranslational modifications. Examples of modifications include acetylation, amidation, blocking, formylation, gamma-carboxyglutamic acid hydroxylation, glycosilation, methylation, phosphorylation and sulfatation. If more than one substituted or additional or heterologous amino acid residue is present in the peptide, the amino acid residues may be the same or different from one another.

In one preferred embodiment of the invention, the functionally active variant of the peptide of the invention is essentially identical to the protective peptide of subgroup i), the additional protective peptide as defined below or the supportive peptide as defined below, but differs from the peptide of the SEQ ID NOS:1, 2, 3, 4, 5, 6, 7 or 8, respectively, in that it is derived from a homologous sequence of a different serotype of *S. pneumoniae*. As detailed above, more than 90 different serotypes of pneumococci have been identified so far. Accordingly, any of these serotypes may be the basis for the functionally active variant. However, preferably the strain is R6, TIGR4_Tettelin, or TIGR4_IC. The serotype is preferably 1, 2, 3, 4, 5, 6 (especially 6A or 6B), 7 (especially 7F), 8, 9 (especially 9N or 9V), 10 (especially 10A), 11 (especially 11A), 12 (especially 12F), 14, 15 (especially 15B), 17 (especially 17F), 18 (especially 18C), 19 (especially 19A or 19F), 20, 22 (especially 22F), 23 (especially 23F), or 33 (especially 33F). In a preferred embodiment, the serotype is 4, 6B, 14, 19A and 19F or 23F.

Examples of variants of peptides of SEQ ID NOS: 1, 2, 3, 4 and 5 derived from other strains or serotypes of *S. pneumoniae* are shown in Table 2, Tables 4 to 8, and Table 9, as well as in the Sequence Listing.

Examples of variants of peptides of SEQ ID NO: 6 derived from other strains or serotypes of *S. pneumoniae* are shown in SEQ ID NOs 206-218 in the Sequence Listing.

Examples of variants of peptides of SEQ ID NO: 7 derived from other strains or serotypes of *S. pneumoniae* are shown in SEQ ID NOs 219-317 in the Sequence Listing.

Examples of variants of peptides of SEQ ID NO: 8 derived from other strains or serotypes of *S. pneumoniae* are shown in SEQ ID NOs 318-331 in the Sequence Listing.

Further examples of homologous sequences of different serotypes and/or different *S. pneumoniae* strains are detailed below and are disclosed also in the attached sequence data.

Table 9 lists several different *S. pneumoniae* strains and their serotypes. From most of those strains one or more of the five full length proteins SP0498, SP0609, SP0749, SP2027 and SP2194 have been sequenced; "n.d." shows, when a sequence has not been determined.

If the full length amino acid sequence of SP0498 from the respective strain listed in Table 9 has been confirmed by DNA sequencing and is identical to the full length amino acid sequence of SP0498 from TIGR4_Tettelin, this is indicated with "IDENT." in the second column of Table 9. If the full length amino acid sequence of SP0498 from the respective strain is different from the full length amino acid sequence of SP0498 from TIGR4_Telletin, i.e. has at least one amino acid substitution, insertion or deletion, the respective SEQ ID NO (as listed in the Sequence Listing) of the full length SP0498 of said strain is given in the second column of Table 9. Accordingly, the full length amino acid sequences of SP0498 from strains with at least one amino acid difference compared to TIGR4_Tettelin are shown as SEQ ID NOs:45 to 93.

If the full length amino acid sequence of SP0609 from the respective strain listed in Table 9 has been confirmed by DNA sequencing and is identical to the full length amino acid sequence of SP0609 from TIGR4_Tettelin, this is indicated with "IDENT." in the third column of Table 9. If the full length amino acid sequence of SP0609 from the respective strain is different from the full length amino acid sequence of SP0609 from TIGR4_Tettelin, i.e. has at least one amino acid substitution, insertion or deletion, the respective SEQ ID NO (as listed in the Sequence Listing) of the full length SP0609 of said strain is given in the third column of Table 9. Accordingly, the full length amino acid sequences of SP0609 from strains with at least one amino acid difference compared to TIGR4_Tettelin are shown as SEQ ID NOs:94 to 136.

If the full length amino acid sequence of SP0749 from the respective strain listed in Table 9 has been confirmed by DNA sequencing and is identical to the full length amino acid sequence of SP0749 from TIGR4_Tettelin, this is indicated with "IDENT." in the fourth column of Table 9. If the full length amino acid sequence of SP0749 from the respective strain is different from the full length amino acid sequence of SP0749 from TIGR4_Tettelin, i.e. has at least one amino acid substitution, insertion or deletion, the respective SEQ ID NO (as listed in the Sequence Listing) of the full length SP0749 of said strain is given in the fourth column of Table 9. Accordingly, the full length amino acid sequences of SP0749 from strains with at least one amino acid difference compared to TIGR4_Tettelin are shown as SEQ ID NOs:137 to 172.

If the full length amino acid sequence of SP2027 from the respective strain listed in Table 9 has been confirmed by DNA sequencing and is identical to the full length amino acid sequence of SP2027 from TIGR4_Tettelin, this is indicated with "IDENT." in the fifth column of Table 9. If the full length amino acid sequence of SP2027 from the respective strain is different from the full length amino acid sequence of SP2027 from TIGR4_Tettelin, i.e. has at least one amino acid substitution, insertion or deletion, the respective SEQ ID NO (as listed in the Sequence Listing) of the full length SP2027 of said strain is given in the fifth column of Table 9. Accordingly, the full length amino acid sequences of SP2027 from strains with at least one amino acid difference compared to TIGR4_Tettelin are shown as SEQ ID NOs:173 to 186.

If the full length amino acid sequence of SP2194 from the respective strain listed in Table 9 has been confirmed by DNA sequencing and is identical to the full length amino acid sequence of SP2194 from TIGR4_Tettelin, this is indicated with "IDENT." in the sixth column of Table 9. If the full length amino acid sequence of SP2194 from the respective strain is different from the full length amino acid sequence of SP2194 from TIGR4_Tettelin, i.e. has at least one amino acid substitution, insertion or deletion, the respective SEQ ID NO (as listed in the Sequence Listing) of the full length SP2194 of said strain is given in the sixth column of Table 9. Accordingly, the full length amino acid sequences of SP2194 from strains with at least one amino acid difference compared to TIGR4_Tettelin are shown as SEQ ID NOs:187 to 205.

The genomic sequences from different *S. pneumoniae* strains may be obtained from the following sources:

a) *Streptococcus pneumonia* TIGR4 (also referred to as TIGR4_Tettelin, as described in Tettelin et al. (2001), Science 293:498-506)
(GenBank accession number: AE005672; remark: completed)

b) *Streptococcus pneumonia* R6
(GenBank accession number: AE007317; remark: completed)

c) *Streptococcus pneumoniae* Serotype 2 Strain D39
(GenBank accession number: CP000410; remark: completed)

d) *Streptococcus pneumonia* GM
(GenBank accession number: -; remark: unfinished)

The term "functionally active variant" includes naturally occurring allelic variants, as well as mutants or any other non-naturally occurring variants. As is known in the art, an allelic variant is an alternate form of a (poly)peptide that is characterized as having a substitution, deletion, or addition of one or more amino acids that does essentially not alter the biological function of the polypeptide. By "biological function" is meant a function of the peptide in the cells in which it naturally occurs, even if the function is not necessary for the growth or survival of the cells. For example, the biological function of a porin is to allow the entry into cells of compounds present in the extracellular medium. The biological function is distinct from the antigenic function. A polypeptide can have more than one biological function.

Accordingly, the present invention also relates to antigenic peptides, i.e. protective peptides and functionally active variants thereof, optionally in combination with one or more additional protective peptides or functionally active variants thereof as defined below, and/or optionally in combination with one or more supportive peptides or functionally active variants thereof as defined below, of different *S. pneumoniae* isolates. Such homologues may easily be identified and isolated based on the nucleic acid and amino acid sequences disclosed herein. A homologous protective peptide, additional protective peptide or supportive peptide of a different serotype may be identified by e.g. sequence alignment. The homologous sequence may vary from the protective peptide of subgroup i), the additional protective peptide as defined below or the supportive peptide as defined below of the sequence of SEQ ID NOS:1, 2, 3, 4, 5, 6, 7 or 8, respectively, by one or more amino acid substitutions, deletions and/or additions.

Percentage of sequence identity can be determined e.g. by sequence alignment. Methods of alignment of sequences for comparison are well known in the art. Various programs and alignment algorithms have been described e.g. in Smith and Waterman (1981), Adv. Appl. Math. 2: 482 or Pearson and Lipman (1988), Proc. Natl. Acad. Sci. U.S.A. 85: 2444-48.

The NCBI Basic Local Alignment Search Tool (BLAST) (Altschul et al. (1990), J. Mol. Biol. 215: 403-10) is available from several sources, including the National Center for Biotechnology Information (NCBI, Bethesda, Md.) and on the Internet, for use in connection with the sequence analysis programs blastp, blastn, blastx, tblastn and tblastx. Variants, e.g. of any protective, additional protective or supportive peptide of the sequences of SEQ ID NOS: 1 to 8 are typically characterized using the NCBI Blast 2.0, gapped blastp set to default parameters. For comparisons of amino acid sequences of e.g. at least 35 amino acids, the Blast 2 sequences function may be employed using the default BLOSUM62 matrix set to default parameters, (gap existence cost of 11, and a per residue gap cost of 1).

In a preferred embodiment, the functionally active variant derived from the peptide as defined above by amino acid exchanges, deletions or insertions may also conserve, or more preferably improve, the activity (as defined above). Furthermore, these peptides may also cover epitopes, which trigger the same or preferably an improved T cell response. These epitope are referred to as "heteroclitic". They have a similar or preferably greater affinity to MHC/HLA molecules, and the ability to stimulate the T cell receptors (TCR) directed to the original epitope in a similar or preferably stronger manner. Heteroclitic epitopes can be obtained by rational design i.e. taking into account the contribution of individual residues to binding to MHC/HLA as for instance described by (Rammensee, H. et al. (1999), Immunogenetics. 50: 213-19), combined with a systematic exchange of residues potentially interacting with the TCR and testing the resulting sequences with T cells directed against the original epitope. Such a design is possible for a skilled man in the art without much experimentation.

Conservative substitutions are those that take place within a family of amino acids that are related in their side chains and chemical properties. Examples of such families are amino acids with basic side chains, with acidic side chains, with non-polar aliphatic side chains, with non-polar aromatic side chains, with uncharged polar side chains, with small side chains, with large side chains etc. In one embodiment, one conservative substitution is included in the peptide. In another embodiment, two conservative substitutions or less are included in the peptide. In a further embodiment, three conservative substitutions or less are included in the peptide.

Examples of conservative amino acid substitutions include, but are not limited to, those listed below:

| Original Residue | Conservative Substitutions |
|---|---|
| Ala | Ser |
| Arg | Lys |
| Asn | Gln; His |
| Asp | Glu |
| Cys | Ser |
| Gln | Asn |
| Glu | Asp |
| His | Asn; Gln |
| Ile | Leu; Val |
| Leu | Ile; Val |
| Lys | Arg; Gln; Asn |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

In another embodiment of the invention the peptide as defined above may be modified by one or more of a variety of chemical techniques to produce derivatives having essentially the same activity (as defined above for fragments and variants) as the modified peptides, and optionally having other desirable properties. For example, carboxylic acid groups of the protein, whether C-terminal or side chain, may be provided in the form of a salt of a pharmaceutically-acceptable cation or esterified to form an ester, or converted to an amide. Amino groups of the peptide, whether amino-terminal or side chain, may be in the form of a pharmaceutically-acceptable acid addition salt, such as the HCl, HBr, acetic, benzoic, toluene sulfonic, maleic, tartaric and other organic salts, or may be converted to an amide. Hydroxyl groups of the peptide side chains may be converted to alkoxy or to an ester using well recognized techniques. Phenyl and phenolic rings of the peptide side chains may be substituted with one or more halogen atoms, such as fluorine, chlorine, bromine or iodine, or with alkyl, alkoxy, carboxylic acids and esters thereof, or amides of such carboxylic acids. Thiols can be protected with any one of a number of well recognized protecting groups, such as acetamide groups.

Peptides of this invention may be in combination with outer surface proteins or other proteins or antigens of other proteins. In such combination, the peptide(s) may be in the form of one or more fusion proteins. The antigenic peptide or supportive peptide of the invention may be optionally fused to a selected peptide or protein derived from other microorganisms. For example, a peptide or protein of this invention may be fused at its N-terminus or C-terminus to a polypeptide from another pathogen or to more than one polypeptide in sequence. Peptides which may be useful for this purpose include polypeptides identified by the prior art.

In a preferred embodiment of the invention the peptide of the invention is fused to an epitope tag which provides an epitope to which an anti-tag substance can selectively bind. The epitope tag is generally placed at the N- or C-terminus of the peptide but may be incorporated as an internal insertion or substitution as the biological activity permits. The presence of such epitope-tagged forms of a peptide can be detected using a substance such as an antibody against the tagged peptide. Also, provision of the epitope tag enables the peptide to be readily purified by affinity purification using an anti-tag antibody or another type of affinity matrix that binds to the epitope tag. Various tag polypeptides and their respective antibodies are well known in the art. Examples include a poly-histidine (poly-his) tag, e.g. a hexa-histidine tag as described in the Examples, a poly-histidine-glycine (poly-his-gly) tag, the HA tag polypeptide, the c-myc tag, the Strep tag and the FLAG tag.

Fusions also may include the peptides of this invention fused or coupled to moieties other than amino acids, including lipids and carbohydrates. Further, peptides/proteins/compositions of this invention may be employed in combination with other vaccinal agents described by the prior art, as well as with other species of vaccinal agents derived from other microorganisms. Such proteins are useful in the prevention, treatment and diagnosis of diseases caused by a wide spectrum of Streptococcus isolates.

These fusion proteins are constructed for use in the methods and compositions of this invention. These fusion proteins or multimeric proteins may be produced recombinantly, or may be synthesized chemically.

The peptides and proteins described herein may be prepared by any of a number of conventional techniques. Desired peptides may be chemically synthesized. An alternative approach involves generating the fragments of known peptides by enzymatic digestion, e.g., by treating the protein with an enzyme known to cleave proteins at sites defined by particular amino acid residues, or by digesting the DNA with suitable restriction enzymes, expressing the digested DNA and isolating the desired fragment. Yet another suitable technique involves isolating and amplifying a DNA fragment encoding a desired peptide fragment, by polymerase chain reaction (PCR). Oligonucleotides that define the desired termini of the DNA fragment are employed as the 5' and 3' primers in the PCR. Techniques for making mutations, such as deletions, insertions and substitutions, at predetermined sites in DNA, and therefore in proteins, having a known sequence are well known. One of skill in the art using conventional techniques, such as PCR, may readily use the peptides, proteins and compositions provided herein to identify and isolate other similar proteins. Such methods are routine and not considered to require undue experimentation, given the information provided herein. For example, variations can be made using oligonucleotide-mediated site-directed mutagenesis (Carter et al. (1985), Nucl. Acids Res. 13: 4431; Zoller et al. (1987), Nucl. Acids Res. 10: 6487), cassette mutagenesis (Wells et al. (1985), Gene, 34: 315), restriction selection mutagenesis (Wells et al. (1986), Philos. Trans. R. Soc. London SerA 317: 415), PCR mutagenesis, or other known techniques can be performed on the cloned DNA to produce the peptide or composition of the invention.

Another subject of the invention relates to a composition comprising at least two proteins selected from the group consisting of a protective protein comprising or consisting of the protective peptide or functionally active variant thereof as described above.

Another subject of the invention relates to a composition comprising at least two proteins selected from the group consisting of i) a protective protein comprising or consisting of the antigenic peptide of subgroup i);
ii) an additional protective protein comprising or consisting of the additional protective peptide consisting of the amino acid sequence of the SEQ ID NO: 6 or 7, or a functionally active variant thereof, and
iii) a supportive protein comprising or consisting of the supportive peptide of the SEQ ID NO:8 or a functionally active variant thereof, wherein the at least two proteins are selected from at least two of the subgroups i), ii) and iii).

The additional protective peptides of the amino acid sequence of the SEQ ID NO:6 or 7 and functionally active variants thereof are referred to as antigenic peptides of subgroup ii). Antigenic peptides of subgroup i) and ii) are referred to as antigenic peptides.

The supportive peptides of the amino acid sequence of the SEQ ID NO:8 and functionally active variants thereof are referred to as supportive peptides of subgroup iii).

The additional protective peptide consisting of the amino acid sequence of SEQ ID NO:6 is derived from S. pneumoniae serotype 4 strain TIGR4_Tettelin and has been denoted by SP2216-1. The additional protective peptide consisting of the amino acid sequence of SEQ ID NO:7 is derived from S. pneumoniae serotype 6B strain Pj-1259 and has been denoted by SP1732-3. The amino acid and DNA sequences of the full length proteins from which the additional protective peptides consisting of the amino acid sequence of the SEQ ID NO:6 and 7 are disclosed in WO 04/092209 as SEQ ID NO:243 and 99, and SEQ ID NO:214 and 70, respectively. However, the sequences of SEQ ID NO:214 and 70 as disclosed in WO 04/092209 relate to S. pneumoniae strain TIGR4_Tettelin, whereas the SEQ ID NO:7 of the present invention relates to S. pneumoniae serotype 6B strain Pj-1259. It is noted that SEQ ID NO:7 of the present invention differs from that of WO 04/092209 in that at position 279 of SEQ ID NO:7 there is a V (valine) as compared to an A (alanine) in the sequence of WO 04/092209.

The amino acid sequences of SEQ ID NO:6 and 7 are disclosed in the Examples as well as in the attached Sequence Listing. The peptides of SEQ ID NO:6 and/or 7 have been shown to induce a protective immune response against S. pneumoniae in a sepsis and/or pneumonia model (see Examples and Figures).

Functionally active variants may be obtained by changing the sequence of the additional protective peptides as defined herein and are characterized by having a biological activity similar to that displayed by the additional protective peptide of the sequence of SEQ ID NO:6 or 7 from which the variant is derived, including the ability to induce protective immune responses and/or to show protection against S. pneumoniae e.g. in a sepsis and/or pneumonia model, wherein any variant may be tested in any of the tests described in the Examples.

The functionally active variant of an additional protective peptide may be obtained as described above.

In a preferred embodiment of the invention the functionally active variant of the additional protective peptide consisting of the amino acid sequence of the SEQ ID NO:6 or 7 a) is a functionally active fragment of the additional protective peptide, the functionally active fragment comprising at least 75% of the sequence of the additional protective peptide, preferably at least 80%, more preferably at least 85%, still more preferably at least 90%, even more preferably at least 95% and most preferably at least 97%, 98% or 99%;
b) is derived from the additional protective peptide by at least one amino acid substitution, addition and/or deletion, wherein the functionally active variant has a sequence identity to the additional protective peptide or to the functionally active fragment as defined in a) of at least 75%, preferably at least 80%, more preferably at least 85%, still more preferably at least 90%, even more preferably at least 95% and most preferably at least 97%, 98% or 99%; and/or
c) consists of the additional protective peptide or a functionally active variant thereof, preferably the variant of a) and/or b), and additionally at least one amino acid heterologous to the additional protective peptide.

The functionally active variant of the additional protective peptide according to the invention is characterized by having a biological activity similar to that displayed by the additional protective peptide, including the ability to induce protective immune responses and/or to show protection against *S. pneumoniae* e.g. in a sepsis and/or pneumonia model. The variant of the additional protective peptide is functionally active in the context of the present invention, if the activity of the variant amounts to at least 10%, preferably at least 25%, more preferably at least 50%, even more preferably at least 70%, still more preferably at least 80%, especially at least 90%, particularly at least 95%, most preferably at least 99% of the activity of the additional protective peptide without sequence alteration. The activity of the variant of the additional protective peptide may be determined or measured as described in the Examples and then compared to that obtained for the additional protective peptide of the amino acid sequence of SEQ ID NO:6 or 7.

The functionally active fragment of the additional protective peptide is characterized by being derived from the protective peptide of SEQ ID NO:6 or 7 by one or more amino acid deletions resulting in a peptide comprising at least 75% of the sequence of the additional protective peptide, preferably at least 80%, more preferably at least 85%, still more preferably at least 90%, even more preferably at least 95% and most preferably at least 97%, 98% or 99%. Sequence identity may be determined as described below. The amino acid deletion(s) may be C-terminally, N-terminally and/or internally. Preferably the fragment is obtained by 1, 2, 3, 4, 5, 6, 7, 8, 9 or 10, more preferably 1, 2, 3, 4 or 5, even more preferably 1, 2 or 3, still more preferably 1 or 2, most preferably 1 amino acid deletion(s).

Alternatively or additionally the variant may be obtained from the additional protective peptide by at least one amino acid substitution, addition and/or deletion, wherein the functionally active variant has a sequence identity to the additional protective peptide or to the functionally active fragment as defined in a) of at least 75%, preferably at least 80%, more preferably at least 85%, still more preferably at least 90%, even more preferably at least 95% and most preferably at least 97%, 98% or 99%. Sequence identity may be determined as described below. The amino acid substitution(s), addition(s) and/or deletion(s) may be C-terminally, N-terminally and/or internally. Preferably the functionally active variant is obtained from the additional protective peptide or the fragment, preferably the additional protective peptide, by 1, 2, 3, 4, 5, 6, 7, 8, 9 or 10, more preferably 1, 2, 3, 4 or 5, even more preferably 1, 2 or 3, still more preferably 1 or 2, most preferably 1 amino acid substitution(s), addition(s) and/or deletion(s).

Furthermore, the variant may consist of the additional protective peptide or the functionally active variant thereof, preferably the variant of a) and/or b), and at least one amino acid residue heterologous to the additional protective peptide or variant thereof, such as a marker protein. The feature "heterologous amino acid" or "amino acid heterologous to the additional protective peptide or variant thereof" refers to any amino acid which is different from that amino acid located adjacent to the additional protective protein in any naturally occurring protein of *S. pneumoniae*, particularly from that of *S. pneumoniae* strain TIGR4_Tettelin or serotype 6B, especially the sequence made reference to above. Therefore, the protein of the invention encompassing at least one heterologous amino acid refers to a protein which is different from any naturally occurring protein of *S. pneumoniae*, particularly from that of *S. pneumoniae* strain TIGR4_Tettelin or serotype 6B. The one or more additional amino acids may be C-terminally, N-terminally or C- and N-terminally to the additional protective peptide or variant thereof.

The supportive peptide consisting of the amino acid sequence of SEQ ID NO:8 is derived from pneumococcal surface adhesin A (PsaA) from *S. pneumoniae* serotype 6B strain Pj-1259. The amino acid and DNA sequences of the full length protein from which the supportive peptide consisting of the amino acid sequence of the SEQ ID NO:8 is disclosed in U.S. Pat. No. 5,854,416 as SEQ ID NO:2 and 1 (GenBank accession numbers: AAE22907 and AR069091). Throughout the entire description of the present invention (including the Figures), PsaA may further be denoted as SP1650.

The amino acid sequence of SEQ ID NO:8 is disclosed in the Examples as well as in the attached Sequence Listing. The peptide of SEQ ID NO:8 has been shown to support induction of a protective immune response against *S. pneumoniae* in a sepsis and/or pneumonia model (see Examples and Figures), if used in combination with the antigenic peptides of the invention.

Functionally active variants may be obtained by changing the sequence of the supportive peptide as defined herein and are characterized by having a supportive activity similar to that displayed by the supportive peptide of the sequence of SEQ ID NO:8 from which the variant is derived, including the ability to induce protective immune responses and/or to show protection against *S. pneumoniae* e.g. in a sepsis and/or pneumonia model in combination with one or more antigenic peptides of the invention, wherein any variant may be tested in any of the tests described in the Examples.

The functionally active variant of a supportive peptide may be obtained by sequence alterations in the supportive peptide, wherein the peptide with the sequence alterations retains a function of the unaltered protective peptide, e.g. having a biological activity similar to that displayed by the unaltered supportive peptide (see above). Such sequence alterations can include, but are not limited to, (conservative) amino acid substitutions, deletions, mutations and insertions. For further details on alterations and variants see above.

In a preferred embodiment the functionally active variant of the supportive peptide
a) is a functionally active fragment of the supportive peptide, the functionally active fragment comprising at least 60% of the sequence of the supportive peptide, preferably at least 70%, more preferably at least 80%, still more preferably at least 90%, even more preferably at least 95% and most preferably at least 97%, 98% or 99%;
b) is derived from the supportive peptide by at least one amino acid substitution, addition and/or deletion and has a sequence identity to the supportive peptide or to the functionally active fragment as defined in a) of at least 60%, preferably at least 70%, more preferably at least 80%, still more preferably at least 90%, even more preferably at least 95% and most preferably at least 97%, 98% or 99%; and/or
c) consists of the supportive peptide or a functionally active variant thereof, preferably the variant of a) and/or b), and additionally at least one amino acid heterologous to the supportive peptide.

The functionally active variant of the supportive peptide according to the invention is characterized by having a biological activity similar to that displayed by the supportive peptide, including the ability to support induction of a protective immune response against different serotypes and/or protection against *S. pneumoniae* in a sepsis and/or pneumonia model (see Examples), if used in combination with the antigenic peptides of the invention.

The variant of the supportive peptide is functionally active in the context of the present invention, if the activity of the variant in combination with the antigenic peptide(s) of the invention amounts to at least 10%, preferably at least 25%, more preferably at least 50%, even more preferably at least 70%, still more preferably at least 80%, especially at 90%, particularly at least 95%, most preferably at least 99% of the activity of the supportive peptide in combination with the antigenic peptide(s) of the invention without sequence alteration. The activity of the variant of the supportive peptide in combination with the antigenic peptide(s) of the invention may be determined or measured as described in the Examples and then compared to that obtained for the supportive peptide of the amino acid sequence of SEQ ID NO:8 in combination with the antigenic peptide(s) of the invention.

The functionally active fragment of the supportive peptide is characterized by being derived from the supportive peptide of SEQ ID NO:8 by one or more deletions resulting in a peptide comprising at least 60% of the sequence of the supportive peptide, preferably at least 70%, more preferably at least 80%, still more preferably at least 90%, even more preferably at least 95% and most preferably at least 97%, 98% or 99%. Sequence identity may be determined as described above. The deletion(s) may be C-terminally, N-terminally and/or internally. Preferably the fragment is obtained by 1, 2, 3, 4, 5, 6, 7, 8, 9 or 10, more preferably 1, 2, 3, 4 or 5, even more preferably 1, 2 or 3, still more preferably 1 or 2, most preferably 1 deletion(s).

Alternatively or additionally the variant may be obtained from the supportive peptide by at least one amino acid substitution, addition and/or deletion, wherein the functionally active variant has a sequence identity to the supportive peptide or to the functionally active fragment as defined in a) of at least 60%, preferably at least 70%, more preferably at least 80%, still more preferably at least 90%, even more preferably at least 95% and most preferably at least 97%, 98% or 99%. Sequence identity may be determined as described above. The substitution(s), addition(s) and/or deletion(s) may be C-terminally, N-terminally and/or internally. Preferably the functionally active variant is obtained from the supportive peptide or the fragment, preferably the supportive peptide, by 1, 2, 3, 4, 5, 6, 7, 8, 9 or 10, more preferably 1, 2, 3, 4 or 5, even more preferably 1, 2 or 3, still more preferably 1 or 2, most preferably 1 amino acid substitution(s), addition(s) and/or deletion(s).

Furthermore, the variant may consist of the supportive peptide or the functionally active variant thereof, preferably the variant of a) and/or b), and at least one amino acid residue heterologous to the supportive peptide or variant thereof, such as a marker protein. The feature "heterologous amino acid" or "amino acid heterologous to the supportive peptide or variant thereof" refers to any amino acid which is different from that amino acid located adjacent to the supportive protein in any naturally occurring protein of S. pneumoniae, especially the sequence made reference to above. The one or more additional amino acids may be C-terminally, N-terminally or C- and N-terminally to the supportive peptide or variant thereof.

Another subject of the invention relates to a composition comprising at least three proteins selected from the group consisting of i) a protective protein comprising or consisting of the antigenic peptide of subgroup i);
ii) an additional protective protein comprising or consisting of the antigenic peptide of subgroup ii), and
iii) a supportive protein comprising or consisting of the supportive peptide of subgroup iii), wherein the at least three proteins are selected from at least two of the subgroups i), ii), and iii).

In one preferred embodiment the composition of the invention comprises at least one protein selected from the subgroup i), and at least two proteins selected from the subgroups ii) and/or iii).

In another preferred embodiment the composition of the invention comprises at least three proteins selected from the three subgroups i), ii), and iii).

In still another preferred embodiment the composition of the invention is defined in that two or more proteins of the at least two proteins are combined into one fusion protein. HI Accordingly, the two or more proteins may be combined into one or more fusion proteins. The resulting fusion protein(s) may encompass two or more of the proteins of subgroups i), ii) and/or iii) as defined above.

The fusion protein may comprise or consist of two or more proteins as defined above. Additionally, the fusion protein may encompass a linker, such as a protein linker, to connect the two or more proteins or additional C- or N-terminal sequences, such as a tag in order to purify the fusion protein. Additional sequences may also result from genetic engineering and the use of suitable restriction sites when preparing the nucleic acid sequences underlying the fusion protein.

A protein of SEQ ID NO:1 to 8 is intended to relate to a protective/additional protective/supportive protein comprising or consisting of a peptide of SEQ ID NO:1 to 8, respectively, as defined above. A variant of a protein of SEQ ID NO:1 to 8 is intended to relate to a protective/additional protective/supportive protein comprising or consisting of a functionally active variant of SEQ ID NO:1 to 8, respectively, as defined above.

The proteins of subgroup i), ii) and/or iii) combined in a fusion protein may be directly joined to each other or may be combined over a linker. The linker may be e.g. a short amino acid sequence. The linker may result from the genetic engineering of a suitable fusion protein or may be introduced in order to allow the single proteins to operate effectively.

In another embodiment of the invention the composition may comprise at least one further protein of subgroup i), ii) and/or iii) in addition to the fusion protein as detailed above.

In another preferred embodiment the composition of the invention comprises at least one protein as defined in i) and at least one protein as defined in ii); or
at least one protein as defined in i) and at least one protein as defined in iii); or
at least one protein as defined in i) and at least two proteins as defined in ii); or
at least one protein as defined in i) and at least two proteins as defined in iii) or
at least one protein as defined in i) and at least one protein as defined in ii) and at least one protein as defined in iii).

More preferably, the composition of the invention as defined in any of the above embodiments comprises at least one protein comprising or consisting of the amino acid sequence of SEQ ID NO:1, 2, 3, 4, or 5 and at least one protein comprising or consisting of the amino acid sequence of SEQ ID NO:6; or
at least one protein comprising or consisting of the amino acid sequence of SEQ ID NO:1, 2, 3, 4, or 5 and at least one protein comprising or consisting of the amino acid sequence of SEQ ID NO:7; or
at least one protein comprising or consisting of the amino acid sequence of SEQ ID NO:1, 2, 3, 4, or 5 and at least one protein comprising or consisting of the amino acid sequence of SEQ ID NO:8; or
at least one protein comprising or consisting of the amino acid sequence of SEQ ID NO:1, 2, 3, 4, or 5 and at least one protein comprising or consisting of the amino acid sequence of SEQ ID NO:6 and at least one protein comprising or consisting of the amino acid sequence of SEQ ID NO:7; or at least one protein comprising or consisting of the amino acid sequence of SEQ ID NO: 1, 2, 3, 4, or 5 and at least one protein comprising or consisting of the amino acid sequence of SEQ ID NO:6 and at least one protein comprising or consisting of the amino acid sequence of SEQ ID NO:8; or at least one protein comprising or consisting of the amino acid sequence of SEQ ID NO: 1, 2, 3, 4, or 5 and at least one protein comprising or consisting of the amino acid sequence of SEQ ID NO:7 and at least one protein comprising or consisting of the amino acid sequence of SEQ ID NO:8.

Examples of the most preferred compositions include the following proteins:

Protein of SEQ ID NO:1, Protein of SEQ ID NO:6 and Protein of SEQ ID NO:7;
Protein of SEQ ID NO:2, Protein of SEQ ID NO:6 and Protein of SEQ ID NO:7;
Protein of SEQ ID NO:3, Protein of SEQ ID NO:6 and Protein of SEQ ID NO:7;
Protein of SEQ ID NO:4, Protein of SEQ ID NO:6 and Protein of SEQ ID NO:7;
Protein of SEQ ID NO:5, Protein of SEQ ID NO:6 and Protein of SEQ ID NO:7;
Protein of SEQ ID NO:1, Protein of SEQ ID NO:7 and Protein of SEQ ID NO:8;
Protein of SEQ ID NO:2, Protein of SEQ ID NO:7 and Protein of SEQ ID NO:8;
Protein of SEQ ID NO:3, Protein of SEQ ID NO:7 and Protein of SEQ ID NO:8;
Protein of SEQ ID NO:4, Protein of SEQ ID NO:7 and Protein of SEQ ID NO:8; or
Protein of SEQ ID NO:5, Protein of SEQ ID NO:7 and Protein of SEQ ID NO:8.

In a preferred embodiment the composition of the invention comprises a functionally active variant of the additional protective peptide wherein the functionally active variant a) is a functionally active fragment of the additional protective peptide, the functionally active fragment comprising at least 60% of the sequence of the supportive peptide, preferably at least 70%, more preferably at least 80%, still more preferably at least 90%, even more preferably at least 95% and most preferably at least 97%, 98% or 99%;

b) is derived from the additional protective peptide by at least one amino acid substitution, addition and/or deletion and has a sequence identity to the additional protective peptide or to the functionally active fragment as defined in a) of at least 60%, preferably at least 70%, more preferably at least 80%, still more preferably at least 90%, even more preferably at least 95% and most preferably at least 97%, 98% or 99%; and/or c) consists of the additional protective peptide or a functionally active variant thereof and at least one amino acid heterologous to the additional protective peptide.

In a preferred embodiment the composition of the invention comprises a functionally active variant of the supportive peptide wherein the functionally active variant a) is a functionally active fragment of the supportive peptide, the functionally active fragment comprising at least 60% of the sequence of the supportive peptide, preferably at least 70%, more preferably at least 80%, still more preferably at least 90%, even more preferably at least 95% and most preferably at least 97%, 98% or 99%;

b) is derived from the supportive peptide by at least one amino acid substitution, addition and/or deletion and has a sequence identity to the supportive peptide or to the functionally active fragment as defined in a) of at least 60%, preferably at least 70%, more preferably at least 80%, still more preferably at least 90%, even more preferably at least 95% and most preferably at least 97%, 98% or 99%; and/or c) consists of the supportive peptide or a functionally active variant thereof and at least one amino acid heterologous to the supportive peptide.

Still another subject of the invention relates to one or more nucleic acid(s) encoding any of the antigenic peptides of subgroup i) as defined above or the one or more protective proteins comprised in the composition of the invention as defined above.

Nucleic acid molecules of the present invention may be in the form of RNA, such as mRNA or cRNA, or in the form of DNA, including, for instance, cDNA and genomic DNA e.g. obtained by cloning or produced by chemical synthetic techniques or by a combination thereof. The DNA may be triple-stranded, double-stranded or single-stranded. Single-stranded DNA may be the coding strand, also known as the sense strand, or it may be the non-coding strand, also referred to as the anti-sense strand. Nucleic acid molecule as used herein also refers to, among other, single- and double-stranded DNA, DNA that is a mixture of single- and double-stranded RNA, and RNA that is a mixture of single- and double-stranded regions, hybrid molecules comprising DNA and RNA that may be single-stranded or, more typically, double-stranded, or triple-stranded, or a mixture of single- and double-stranded regions. In addition, nucleic acid molecule as used herein refers to triple-stranded regions comprising RNA or DNA or both RNA and DNA.

The nucleic acid may be a fragment of a nucleic acid occurring naturally in *S. pneumoniae*, especially in *S. pneumoniae* strains R6 and TIGR4_Tettelin. The serotype is preferably 1, 2, 3, 4, 5, 6 (especially 6A or 6B), 7 (especially 7F), 8, 9 (especially 9N or 9V), 10 (especially 10A), 11 (especially 11A), 12 (especially 12F), 14, 15 (especially 15B), 17 (especially 17F), 18 (especially 18C), 19 (especially 19A or 19F), 20, 22 (especially 22F), 23 (especially 23F), or 33 (especially 33F). In a preferred embodiment, the serotype is 4, 6B, 14, 19A and 19F or 23F.

The nucleic acid also includes sequences that are a result of the degeneration of the genetic code. There are 20 natural amino acids, most of which are specified by more than one codon. Therefore, all nucleotide sequences are included in the invention encoding the peptide as defined above.

Preferably, the one or more nucleic acid(s) comprise(s) or consist(s) of at least one nucleic acid sequence selected from the group consisting of SEQ ID NO:9, SEQ ID NO:10, SEQ ID NO:11, SEQ ID NO:12, and SEQ ID NO:13.

Additionally, the nucleic acid may contain one or more modified bases. Such nucleic acids may also contain modifications e.g. in the ribose-phosphate backbone to increase stability and half life of such molecules in physiological environments. Thus, DNAs or RNAs with backbones modified for stability or for other reasons are "nucleic acid molecule" as that feature is intended herein. Moreover, DNAs or RNAs comprising unusual bases, such as inosine, or modified bases, such as tritylated bases, to name just two examples, are nucleic acid molecule within the context of the present invention. It will be appreciated that a great variety of modifications have been made to DNA and RNA that serve many useful purposes known to those of skill in the art. The term nucleic acid molecule as it is employed herein embraces such chemically, enzymatically or metabolically modified forms of nucleic acid molecule, as well as the chemical forms of DNA and RNA characteristic of viruses and cells, including simple and complex cells, inter alia. For example, nucleotide substitutions can be made which do not affect the peptide or protein or composition of the invention encoded by the nucleic acid, and thus any nucleic acid molecule which encodes an antigenic peptide or functionally active variant thereof or a composition of the invention as defined above is encompassed by the present invention.

Furthermore, any of the nucleic acid molecules encoding an antigenic peptide or composition of the invention can be functionally linked, using standard techniques such as standard cloning techniques, to any desired regulatory sequences, whether a *S. pneumoniae* regulatory sequence or a heterologous regulatory sequence, heterologous leader sequence, heterologous marker sequence or a heterologous coding sequence to create a fusion protein.

The nucleic acid of the invention may be originally formed in vitro or in a cell in culture, in general, by the manipulation of nucleic acids by endonucleases and/or exonucleases and/or polymerases and/or ligases and/or recombinases or other methods known to the skilled practitioner to produce the nucleic acids.

In one embodiment of the invention, the one or more nucleic acid(s) of invention is/are located in a vector or a cell other than *S. pneumoniae*.

A vector may additionally include nucleic acid sequences that permit it to replicate in the host cell, such as an origin of replication, one or more desired genes and/or selectable marker genes and other genetic elements known in the art such as regulatory elements directing transcription, translation and/or secretion of the encoded peptide or protein. The vector may be used to transduce, transform or infect a cell, thereby causing the cell to express inserted nucleic acids and/or proteins other than those native to the cell. The vector optionally includes materials to aid in achieving entry of the nucleic acid into the cell, such as a viral particle, liposome, protein coating or the like. Numerous types of appropriate expression vectors are known in the art for protein expression, by standard molecular biology techniques. Such vectors are selected from among conventional vector types including insects, e.g., baculovirus expression, or yeast, fungal, bacterial or viral expression systems. Other appropriate expression vectors, of which numerous types are known in the art, can also be used for this purpose. Methods for obtaining such expression vectors are well-known (see, e.g. Sambrook et al (1989), Molecular Cloning. A Laboratory Manual, 2nd edition, Cold Spring Harbor Laboratory, New York). In one embodiment, the vector is a viral vector. Viral vectors include, but are not limited to, retroviral and adenoviral vectors.

Suitable host cells or cell lines for transfection by this method include bacterial cells. For example, the various strains of *E. coli* are well-known as host cells in the field of biotechnology. Various strains of *B. subtilis, Pseudomonas, Streptomyces*, and other bacilli and the like may also be employed in this method. Many strains of yeast cells known to those skilled in the art are also available as host cells for expression of the peptides of the present invention. Other fungal cells or insect cells such as *Spodoptera frugipedera* (Sf9) cells may also be employed as expression systems. Alternatively, mammalian cells, such as HeLa, C127, BHK, Bowes melanoma cells, human 293 cells, Chinese hamster ovary cells (CHO), the monkey COS-1 cell line, Vero cells, PER.C6® or murine 3T3 cells derived from Swiss, BALB/c or NIH mice may be used. Still other suitable host cells, as well as methods for transfection, culture, amplification, screening, production, and purification are known in the art.

An antigenic peptide or composition of the invention or component thereof may be produced by expressing a nucleic acid of the invention in a suitable host cell. The host cells can be transfected, e.g. by conventional means such as electroporation with at least one expression vector containing a nucleic acid of the invention under the control of a transcriptional regulatory sequence. The transfected or transformed host cell is then cultured under conditions that allow expression of the protein. The expressed protein is recovered, isolated, and optionally purified from the cell (or from the culture medium, if expressed extracellularly) by appropriate means known to one of skill in the art. For example, the proteins are isolated in soluble form following cell lysis, or extracted using known techniques, e.g. in guanidine chloride. If desired, the peptides or fragments of the invention are produced as a fusion protein. Such fusion proteins are those described above. Alternatively, for example, it may be desirable to produce fusion proteins to enhance expression of the protein in a selected host cell or to improve purification. The molecules comprising the peptides and compositions of this invention may be further purified using any of a variety of conventional methods including, but not limited to: liquid chromatography such as normal or reversed phase, using HPLC, FPLC and the like; affinity chromatography (such as with inorganic ligands or monoclonal antibodies); size exclusion chromatography; immobilized metal chelate chromatography; gel electrophoresis; and the like. One of skill in the art may select the most appropriate isolation and purification techniques without departing from the scope of this invention. Such purification provides the peptide/protein/composition in a form substantially free from other proteinaceous and non-proteinaceous materials of the microorganism.

A further subject of the invention relates to a pharmaceutical composition, especially a vaccine, comprising at least one protective peptide or functionally active variant thereof according to the invention or the composition according to the invention, and optionally a pharmaceutically acceptable carrier or excipient.

An antigenic peptide or composition of the invention may be used for methods for immunizing or treating humans and/or animals with the disease caused by infection with *S. pneumoniae*. Therefore, the antigenic peptide or composition may be used within a pharmaceutical composition. The pharmaceutical composition of the present invention may further encompass pharmaceutically acceptable carriers and/or excipients. The pharmaceutically acceptable carriers and/or excipients useful in this invention are conventional and may include buffers, stabilizers, diluents, preservatives, and solubilizers. Remington's Pharmaceutical Sciences, by E. W. Martin, Mack Publishing Co., Easton, Pa., 15th Edition (1975), describes compositions and formulations suitable for pharmaceutical delivery of the (poly)peptides/proteins herein disclosed.

If the pharmaceutical composition comprises the components of the invention, the proteins of subgroup i), ii) and/or iii) may be formulated into one or more pharmaceutical composition(s). Additionally, the two or more pharmaceutical compositions may be administered together, simultaneously or consecutively.

In general, the nature of the carrier or excipients will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g. powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

In a preferred embodiment the pharmaceutical composition further comprises an immunostimulatory substance such as an adjuvant. The adjuvant can be selected based on the method of administration and may include mineral oil-based adjuvants such as Freund's complete and incomplete adjuvant, Montanide incomplete Seppic adjuvant such as ISA, oil in water emulsion adjuvants such as the Ribi adjuvant system, syntax adjuvant formulation containing muramyl dipeptide, or aluminum salt adjuvants.

In a more preferred embodiment the immunostimulatory substance is selected from the group comprising polycationic polymers, especially polycationic peptides such as polyarginine, immunostimulatory deoxynucleotides (ODNs), especially Oligo(dIdC)$_{13}$, peptides containing at least two LysLeuLys motifs, especially KLKLLLLLKLK (SEQ ID NO:332), neuroactive compounds, especially human growth hormone, alumn, adjuvants and combinations thereof. Preferably the combination is either a polycationic polymer and immunostimulatory deoxynucleotides or a peptide containing at least two LysLeuLys motifs and immunostimulatory deoxynucleotides. In a still more preferred embodiment the polycationic polymer is a polycationic peptide.

The term "Oligo(dIdC)$_{13}$" as used in the present invention means a phosphodiester backboned single-stranded DNA molecule containing 13 deoxy(inosine-cytosine) motifs, also defined by the term [oligo-d(IC)$_{13}$]. The exact sequence is 5'-dIdCdIdCdIdCdIdCdIdCdIdCdIdC-dIdCdIdCdIdCdIdCdIdCdIdCdIdC-3'. Oligo(dIdC)$_{13}$ (SEQ ID NO:333) can also be defined by the terms (oligo-dIC$_{26}$); oligo-dIC$_{26}$-mer; oligo-deoxy IC, 26-mer; or oligo-dIC, 26-mer, as specified for example in WO 01/93903 and WO 01/93905.

In an even more preferred embodiment of the invention the immunostimulatory substance is at least one immunostimulatory nucleic acid. Immunostimulatory nucleic acids are e.g. neutral or artificial CpG containing nucleic acids, short stretches of nucleic acids derived from non-vertebrates or in form of short oligonucleotides (ODNs) containing non-methylated cytosine-guanine dinucleotides (CpG) in a defined base context (e.g. as described in WO 96/02555). Alternatively, also nucleic acids based on inosine and cytidine as e.g. described in WO 01/93903, or deoxynucleic acids containing deoxy-inosine and/or deoxyuridine residues (described in WO 01/93905 and WO 02/095027) may preferably be used as immunostimulatory nucleic acids in the present invention. Preferably, mixtures of different immunostimulatory nucleic acids are used in the present invention. Additionally, the aforementioned polycationic compounds may be combined with any of the immunostimulatory nucleic acids as aforementioned. Preferably, such combinations are according to the ones described in WO 01/93905, WO 02/32451, WO 01/54720, WO 01/93903, WO 02/13857, WO 02/095027 and WO 03/047602.

In addition or alternatively, such vaccine composition may comprise a neuroactive compound. Preferably, the neuroactive compound is human growth factor, e.g. described in WO 01/24822. Also preferably, the neuroactive compound is combined with any of the polycationic compounds and/or immunostimulatory nucleic acids as defined above.

In a highly preferred embodiment of the invention, the adjuvants are those used in the Example, e.g. complete Freund's adjuvant, aluminum hydroxide. In another highly preferred embodiment of the present invention, the adjuvant is IC31® (Intercell; a synthetic adjuvant comprising the peptide motif KLK [WO 02/32451] and an oligonucleotide [WO 01/93905]).

The composition may be used e.g. for immunization or treatment of a subject. The pharmaceutical composition encompasses at least one antigenic peptide or composition of the invention; however, it may also contain a cocktail (i.e., a simple mixture) containing different antigenic peptides (including fragments and variants) or proteins or compositions of the invention, optionally mixed with a supportive peptide or protein or different antigenic peptides or proteins of other pathogens. Such mixtures of these peptides, polypeptides, proteins or fragments or variants thereof are useful e.g. in the generation of desired antibodies to a wide spectrum of S. pneumoniae isolates. The (poly)peptide(s)/composition(s) of the present invention may also be used in the form of a pharmaceutically acceptable salt. Suitable acids and bases which are capable of forming salts with the peptides of the present invention are well known to those of skill in the art, and include inorganic and organic acids and bases.

Alternatively, the pharmaceutical composition comprises
(i) the one or more nucleic acid(s) of the invention or one or more nucleic acid(s) complementary thereto, and
(ii) optionally a pharmaceutically acceptable carrier or excipient.

The nucleic acid sequences, alone or in combination with other nucleic acid sequences encoding peptides/proteins/compositions or antibodies or directed to other pathogenic microorganisms, may further be used as components of a pharmaceutical composition. The composition may be used for immunizing or treating humans and/or animals with the disease caused by infection with S. pneumoniae.

The pharmaceutically acceptable carrier or excipient may be as defined above.

In another embodiment, the nucleic acid sequences of this invention, alone or in combination with nucleic acid sequences encoding other antigens or antibodies from other pathogenic microorganisms, may further be used in compositions directed to actively induce a protective immune response in a subject to the pathogen. These components of the present invention are useful in methods for inducing a protective immune response in humans and/or animals against infection with S. pneumoniae.

For use in the preparation of the therapeutic or vaccine compositions, nucleic acid delivery compositions and methods are useful, which are known to those of skill in the art. The nucleic acid of the present invention or one or more nucleic acid(s) complementary thereto may be employed in the methods of this invention or in the compositions described herein as DNA sequences, either administered as naked DNA, or associated with a pharmaceutically acceptable carrier and provide for in vivo expression of the antigen, peptide or polypeptide. So-called "naked DNA" may be used to express the antigenic peptide or composition of the invention in vivo in a patient. (See, e.g., Cohen, J. (1993), Science 259: 1691-2, which describes similar uses of "naked DNA"). For example, "naked DNA" associated with regulatory sequences may be administered therapeutically or as part of the vaccine composition e.g., by injection.

Alternatively, a nucleic acid encoding the antigenic peptides or compositions of the invention or a nucleic acid complementary thereto may be used within a pharmaceutical composition, e.g. in order to express the antigenic peptide or composition of the invention in vivo, e.g., to induce antibodies.

A preferred embodiment of the invention relates to a pharmaceutical composition, wherein the nucleic acid is comprised in a vector and/or a cell other than S. pneumoniae. Vectors and cells suitable in the context of the present invention are described above. Vectors are particularly employed for a DNA vaccine. An appropriate vector for delivery may be readily selected by one of skill in the art. Exemplary vectors for in vivo gene delivery are readily available from a variety of academic and commercial sources, and include, e.g., adeno-associated virus (WO 91/18088), adenovirus vectors (Kay, M. et al (1994), Proc. Natl. Acad. Sci. USA 91: 2353; Ishibashi, S. et al (1993), J. Clin. Invest. 92: 883), or other viral vectors, e.g., various poxviruses, vaccinia, etc. Recombinant viral vectors, such as retroviruses or adenoviruses, are preferred for integrating the exogenous DNA into the chromosome of the cell.

Also included in the scope of the invention is the production of antibodies against an antigenic peptide or composition according to the invention. This includes, for example, monoclonal and polyclonal antibodies, chimeric, single chain, and humanized antibodies, as well as Fab fragments, or the product of a Fab expression library, which are able to specifically bind to the antigenic peptide or composition according to the invention.

In a preferred embodiment the antibody is a monoclonal, polyclonal, chimeric or humanized antibody or functionally active fragment thereof. In another preferred embodiment the functionally active fragment comprises a Fab fragment.

Antibodies generated against the antigenic peptide or composition according to the invention can be obtained by direct injection of the antigenic peptide or composition according to the invention into an animal or administering of the antigenic peptide or composition according to the invention to an animal, preferably a non-human. The antibody so obtained will then bind the antigenic peptide or composition according to the invention. Such antibodies can then be used to isolate reactive antigens, peptide or proteins from tissue expressing those.

For preparation of monoclonal antibodies, any technique known in the art, which provides antibodies produced by continuous cell line cultures, e.g. a hybridoma cell line, can be used.

Techniques described for the production of single chain antibodies (U.S. Pat. No. 4,946,778) can be adapted to produce single chain antibodies to the antigenic peptides or compositions according to the invention. Also, transgenic mice or other organisms such as other mammals may be used to express humanized antibodies to of the antigenic peptides or compositions according to the invention.

Antibodies may be also produced using a hybridoma cell line. Hybridoma cell lines expressing desirable monoclonal antibodies are generated by well-known conventional techniques. The hybridoma cell can be generated by fusing a normal-activated, antibody-producing B cell with a myeloma cell. In the context of the present invention the hybridoma cell is able to produce an antibody specifically binding to the antigenic peptide or composition according to the invention.

Similarly, desirable high titre antibodies are generated by applying known recombinant techniques to the monoclonal or polyclonal antibodies developed to these peptides/proteins/compositions (see, e.g., WO 86/01533; British Patent Publication No. GB2188638A; Amit et al. (1986), Science 233: 747-53; Queen et al. (1989), Proc. Natl. Acad. Sci. USA 86: 10029-33; WO 90/07861; Riechmann et al. (1988), Nature 332: 323-7; Huse et al. (1988), Science 246: 1275-81).

Accordingly, another subject of the invention is a method for producing an antibody, characterized by the following steps:
(a) administering an effective amount of at least one protective peptide or functionally active variant thereof of the invention as defined above and/or a composition of the invention as defined above to an animal; and
(b) isolating the antibody produced by the animal in response to the administration of step (a) from the animal.

An alternative method of the invention for producing an antibody is characterized by the following steps:
(a) contacting a B cell with an effective amount of at least one protective peptide or functionally active variant thereof of the invention as defined above and/or a composition of the invention as defined above;
(b) fusing the B cell of step (a) with a myeloma cell to obtain a hybridoma cell; and
(c) isolating the antibody produced by the cultivated hybridoma cell.

Particularly, the antibody may be produced by initiating an immune response in a non-human animal by administrating an antigenic peptide or composition of the invention to an animal, removing an antibody containing body fluid from said animal, and producing the antibody by subjecting said antibody containing body fluid to further purification steps. Alternatively, the antibody may be produced by initiating an immune response in a non-human animal by administrating an antigenic peptide or composition, as defined in the present invention, to said animal, removing the spleen or spleen cells from said animal and/or producing hybridoma cells of said spleen or spleen cells, selecting and cloning hybridoma cells specific for the antigenic peptide or composition according to the invention and producing the antibody by cultivation of said cloned hybridoma cells. In a preferred embodiment the antibody produced according to a method of the invention is additionally purified. Methods of purification are known to the skilled artisan.

The antibody may be used in methods for preventing or treating an infection. Accordingly, still another subject of the invention relates to a pharmaceutical composition, especially a vaccine, comprising an antibody produced according to the invention. The pharmaceutical composition may encompass further components as detailed above. The composition may further encompass substances increasing their capacity to stimulate T cells. These include T helper cell epitopes, lipids or liposomes or preferred modifications as described in WO01/78767. Another way to increase the T cell stimulating capacity of epitopes is their formulation with immune stimulating substances for instance cytokines or chemokines like interleukin-2, -7, -12, -18, class I and II interferons (IFN), especially IFN-gamma, GM-CSF, TNF-alpha, flt3-ligand and others.

A further subject of the invention relates to the use of a protective peptide or functionally active variant thereof of the invention as defined above and/or a composition of the invention as defined above and/or the nucleic acid of the invention as defined above for the manufacture of a medicament for the immunization or treatment of a subject, preferably against S. pneumoniae, more preferably against pneumonia, bacteremia, otitis media, meningitis, sinusitis, peritonitis and/or arthritis caused by S. pneumoniae.

The peptides, proteins, compositions or the nucleic acids of the invention are generally useful for inducing an immune response in a subject. The vaccine used for immunization may be administered to a subject susceptible to infection by S.

*pneumoniae*, preferably mammals, and still more preferably humans, in any conventional manner, including oral, topical, intranasal, intramuscular, intra-lymph node, intradermal, intraperitoneal, subcutaneous, and combinations thereof, but most preferably through intramuscular injection. The volume of the dose for intramuscular administration is preferably up to about 5 ml, still more preferably between 0.5 ml and 3 ml, and most preferably about 1 to 2 ml. The volume of the dose when subcutaneous injection is the selected administration route is preferably up to about 5 ml, still more preferably between 0.5 ml and 3 ml, and most preferably about 1 to 2 ml. The amount of substance in each dose should be enough to confer effective immunity against and decrease the risk of developing clinical signs resulting from *S. pneumoniae* infection to a subject receiving a vaccination therewith. Preferably, the unit dose of protein should be up to about 5 µg protein/kg body weight, more preferably between about 0.2 to 3 µg, still more preferably between about 0.3 to 1.5 µg, more preferably between about 0.4 to 0.8 µg, and still more preferably about 0.6 µg. Alternative preferred unit doses of protein could be up to about 6 µg protein/kg body weight, more preferably between about 0.05 to 5 µg, still more preferably between about 0.1 to 4 µg. The dose is preferably administered 1 to 3 times, e.g. with an interval of 1 to 4 weeks. Preferred amounts of protein per dose are from approximately 1 µg to approximately 1 mg, more preferably from approximately 5 µg to approximately 500 µg, still more preferably from approximately 10 µg to approximately 250 µg and most preferably from approximately 25 µg to approximately 100 µg.

In still another aspect of the invention the antibody produced according to the invention or functional fragment thereof is used for the manufacture of a medicament for the treatment of an infection, preferably a *S. pneumoniae* infection. The treatment involves administering an effective amount of the antibody to a subject, preferably a mammal, more preferably a human. Thus, antibodies against the protective peptides or variants thereof or the composition of the present invention may be employed to inhibit and/or treat infections, particularly bacterial infections and especially infections arising from *S. pneumoniae*.

An "effective amount" of peptides, proteins, compositions or the nucleic acids of the invention or an antibody produced according to the invention may be calculated as that amount capable of exhibiting an in vivo effect, e.g. preventing or ameliorating a sign or symptom of infection, particularly *S. pneumoniae* infection. Such amounts may be determined by one of skill in the art. Such a substance may be administered in any conventional manner, including oral, topical, intranasal, intramuscular, intra-lymph node, intradermal, intraperitoneal, subcutaneous, and combinations thereof, but preferably intramuscularly or subcutaneously. However, it may also be formulated to be administered by any other suitable route, including orally or topically. The selection of the route of delivery and dosage of such therapeutic compositions is within the skill of the art.

Treatment in the context of the present invention refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

Still a further subject of the invention relates to a method of diagnosing a *S. pneumoniae* infection comprising the steps of:
(a) contacting a sample obtained from a subject with a protective peptide or functionally active variant thereof of the invention as defined above and/or a composition of the invention as defined above; and
(b) detecting the presence of an antibody against the protective peptide functionally active variant and/or the composition in the sample,
wherein the presence of the antibody is indicative for the *S. pneumoniae* infection.

The antigenic peptides or compositions of the invention may be used for the detection of the *S. pneumoniae*. Preferably such detection is for diagnosis, more preferably for the diagnosis of a disease, most preferably for the diagnosis of a *S. pneumoniae* infection. The antigenic peptides or compositions may be used to detect the presence of a *S. pneumoniae*-specific antibody or fragment thereof e.g. in a sample obtained from a subject. The sample may be e.g. a blood sample. Alternatively, the presence of a *S. pneumoniae*-specific protective peptide can be detected using an antibody prepared according to the method of the invention.

The present invention also relates to diagnostic assays such as quantitative and diagnostic assays for detecting levels of the peptides, proteins or antibodies of the present invention in cells and tissues or body fluids, including determination of normal and abnormal levels. Assay techniques that can be used to determine levels of a peptide, a composition or an antibody, in a sample derived from a host are well known to those of skill in the art. Such assay methods include radioimmunoassays, competitive-binding assays, Western Blot analysis and ELISA assays. Among these, ELISAs frequently are preferred. An ELISA assay initially comprises preparing an antibody specific to the peptide or composition, particularly the protective peptide, preferably a monoclonal antibody. In addition, a reporter antibody generally is prepared which binds to the monoclonal antibody. The reporter antibody is attached to a detectable reagent such as radioactive, fluorescent or enzymatic reagent, such as horseradish peroxidase enzyme.

The antigenic peptides or compositions of the present invention may also be used for the purpose of or in connection with an array. More particularly, at least one of the antigenic peptides or compositions of the present invention may be immobilized on a support. Said support typically comprises a variety of peptides/proteins whereby the variety may be created by using one or several of the peptides or compositions of the present invention. The characterizing feature of such array as well as of any array in general is the fact that at a distinct or predefined region or position on said support or a surface thereof, a distinct polypeptide is immobilized. Because of this any activity at a distinct position or region of an array can be correlated with a specific polypeptide. The number of different peptides or antibodies of the present invention immobilized on a support may range from as little as 10 to several 1000 different peptides or compositions of the present invention. Alternatively, antibodies produced according to the present invention may be used to detect antigenic peptides or compositions of the invention.

The manufacture of such arrays is known to the one skilled in the art and, for example, described in U.S. Pat. No. 5,744,309. The array preferably comprises a planar, porous or non-porous solid support having at least a first surface. Preferred support materials are, among others, glass or cellulose. It is also within the present invention that the array is used for any of the diagnostic applications described herein. Apart from the peptides or antibodies of the present invention also the nucleic acid molecules according to the present invention may be used for the generation of an array as described above.

An alternative method for diagnosing an infection with *S. pneumoniae* comprises the steps of:

a) contacting a sample obtained from a subject with a primer and/or a probe specific for the one or more nucleic acid(s) of the invention; and
b) detecting the presence of one or more nucleic acid(s) of the invention in the sample, wherein the presence of the one or more nucleic acid(s) is indicative for the *S. pneumoniae* infection.

A series of methods for detecting nucleic acids in probes by using specific primers and/or probes is known in the art. In general, these methods are based on the specific binding of a primer or probe to the nucleic acid in question. The methods may involve amplification of the nucleic acid, e.g. RNA or DNA, before the actual detection step. Therefore, primers may be used to specifically induce transcription and/or amplification of RNA or DNA in order to generate a detectable amount of nucleic acid. Suitable well known techniques may be PCR and RT-PCR. Suitable primers and probes for the method of the invention may be produced based on sequence information provided in the present application. Guidelines and computer-assisted programs (e.g. Primer Express®, Applied Biosystems, Foster City, Calif., USA) for designing primers and probes to a specific nucleic acid are known to the person skilled in the art.

After the amplification step the amplified nucleic acid, in general DNA, may be detected e.g. by its size (e.g. involving agarose gel electrophoresis) or using labeled probes which specifically bind to the amplified nucleic acid. The probes may be labeled with a dye, radioactive marker, a fluorescent marker, an enzyme-linked marker or any other marker.

For example, FRET (Förster resonance energy transfer) may be used for the detection of the nucleic acid of the invention. In FRET, a donor fluorophore molecule absorbs excitation energy and delivers this via dipole-dipole interaction to a nearby acceptor fluorophore molecule. This process only occurs when the donor and acceptor molecules are sufficiently close to one another. Several different strategies for determining the optimal physical arrangement of the donor and acceptor moieties are known to the skilled practitioner. For this, a fluorescent donor is excited at its specific fluorescence excitation wavelength. By a long-range dipole-dipole coupling mechanism, this excited state is then nonradiatively transferred to a second molecule, the acceptor. The donor returns to the electronic ground state. The described energy transfer mechanism is termed "Förster resonance energy transfer" (FRET). The process involves measuring fluorescence as FRET donor and acceptor moieties are brought together as a result of DNA hybridization. For examples two probes each labeled with a suitable marker hybridize to the nucleic acid of the invention within a distance which allows FRET to occur. Suitable markers include Cyan 500, Cy5, Cy3, SYBR Green I, fluorescein, HEX, Red 610 and Red 640, wherein the two marker involved have to be selected based on there excitation and emission spectrums as known by the skilled person. A suitable system for the detection of nucleic acids is the LightCycler® (Roche Diagnostics).

A further subject of the invention relates to a method for identifying a ligand capable of binding to a protective peptide or a functionally active variant thereof according to the invention and/or the composition according to the invention comprising:

(a) providing a test system comprising the peptide and/or composition,
(b) contacting the test system with a test compound, and
(c) detecting a signal generated in response to the binding of the test compound to the peptide and/or composition.

More particularly, the method may be carried out by contacting an isolated or immobilized antigenic peptide or composition according to the invention with a candidate ligand under conditions to permit binding of the candidate ligand to the peptide, wherein the test system comprises a component capable of providing a detectable signal in response to the binding of the candidate ligand to said peptide; and detecting the presence or absence of a signal generated in response to the binding of the ligand to the peptide. The ligand may be an agonist or an antagonist.

Test systems for detection binding of a ligand are known to the skilled artisan and include e.g. binding assays with labeled ligand such as radioligands, fluorescence-labeled ligands or enzyme-labeled ligands.

The test compound can be any test compound either naturally occurring or chemically synthesized. Naturally occurring test compounds include in particular antibodies, preferably those showing similarity to the antibodies of the invention. In one preferred embodiment of the invention the test compound is provided in the form of a chemical compound library. Chemical compound libraries include a plurality of chemical compounds and have been assembled from any of multiple sources, including chemically synthesized molecules and natural products, or have been generated by combinatorial chemistry techniques. They are especially suitable for high throughput screening. They may be comprised of chemical compounds of a particular structure or compounds of a particular creature such as a plant.

A further subject of the invention relates to the use of the protective peptide or a functionally active variant thereof according to the invention or the composition according to the invention for the isolation and/or purification and/or identification of an interaction partner of the antigenic peptide and/or composition. The isolation and/or purification and/or identification of the ligand may be carried out as detailed above or as known to the person skilled in the art. In a preferred embodiment of the invention an affinity device may be used. The affinity device may comprise as least a support material and any antigenic peptide or composition according to the present invention, which is attached to the support material. Because of the specificity of the antigenic peptides and/or compositions according to the present invention for their target cells or target molecules or their interaction partners, the antigenic peptides and/or compositions allow a selective removal of their interaction partner(s) from any kind of sample applied to the support material provided that the conditions for binding are met. The sample may be a biological or medical sample, including but not limited to, fermentation broth, cell debris, cell preparation, tissue preparation, organ preparation, blood, urine, lymph liquid, liquor and the like. The peptide or composition may be attached to the matrix in a covalent or non-covalent manner. Suitable support material is known to the one skilled in the art and can be selected from the group comprising cellulose, silicon, glass, aluminum, paramagnetic beads, starch and dextrane.

The present invention is further illustrated by the following Figures, Examples and the Sequence Listing, from which further features, embodiments and advantages may be taken. It is to be understood that the present examples are given by way of illustration only and not by way of limitation of the disclosure.

FIGURE LEGENDS

FIG. 1 shows the protection achieved by active immunization with selected *S. pneumoniae* antigens in a mouse lethality model. C3H/HeN mice (10 mice per group) were immunized with recombinant antigens cloned from the serotype 4 *S. pneumoniae* strain TIGR4_IC and challenged with a serotype 6B strain Pj-1259. Survival was monitored for 2 weeks post-challenge. Mice were immunized subcutaneously with 50 μg of the respective recombinant protein adjuvanted with either aluminum hydroxide (ALUM) (A) or CFA/IFA (B). Mice were then challenged intraperitoneally with $10^4$ cfu *S. pneumoniae* 6B. Adjuvant control mice were used as negative controls, while PspA (SP0117) served as positive control. Survival was monitored for 15 days post challenge and was depicted as percentage of total animals.

Figure 2:
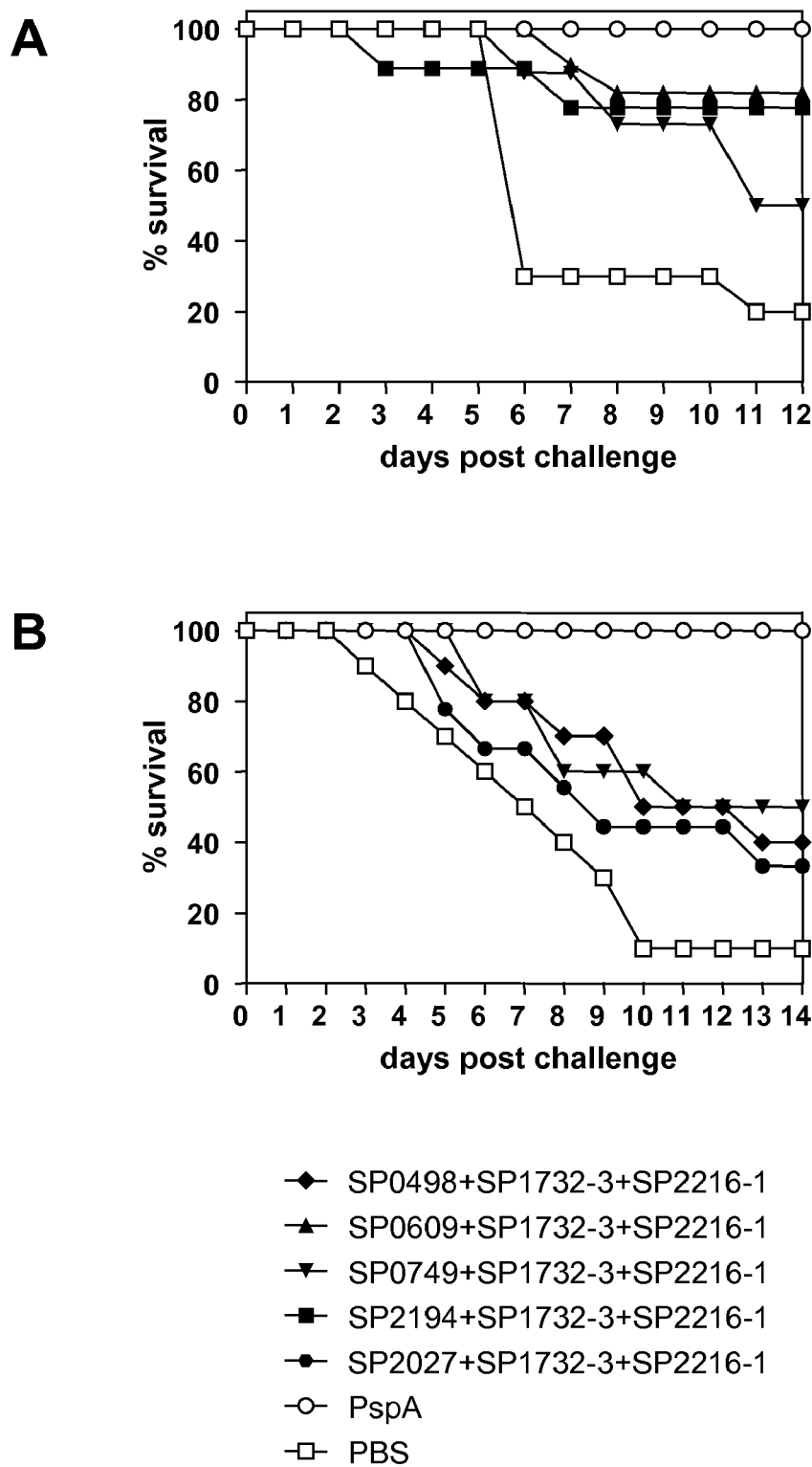

FIG. 2 shows the protection achieved by active immunization with a combination of selected *S. pneumoniae* antigens in combination with SP1732-3 and SP2216-1 in a mouse lethality model. C3H/HeN mice (10 mice per group) were immunized with a combination of recombinant antigens cloned from the serotype 4 *S. pneumoniae* strain TIGR4_IC and challenged with a serotype 6B strain Pj-1259. Survival was monitored for 2 weeks post-challenge. Mice were immunized subcutaneously with a mixture of 50 μg of each recombinant protein antigen adjuvanted with aluminum hydroxide (ALUM). Mice were then challenged intraperitoneally with $10^4$ cfu *S. pneumoniae* 6B. Adjuvant control mice were used as negative controls, while PspA (SP0117) served as positive control. Survival was monitored for 15 days post challenge and was depicted as percentage of total animals. (In A and B two different experiments are depicted).

Figure 3:
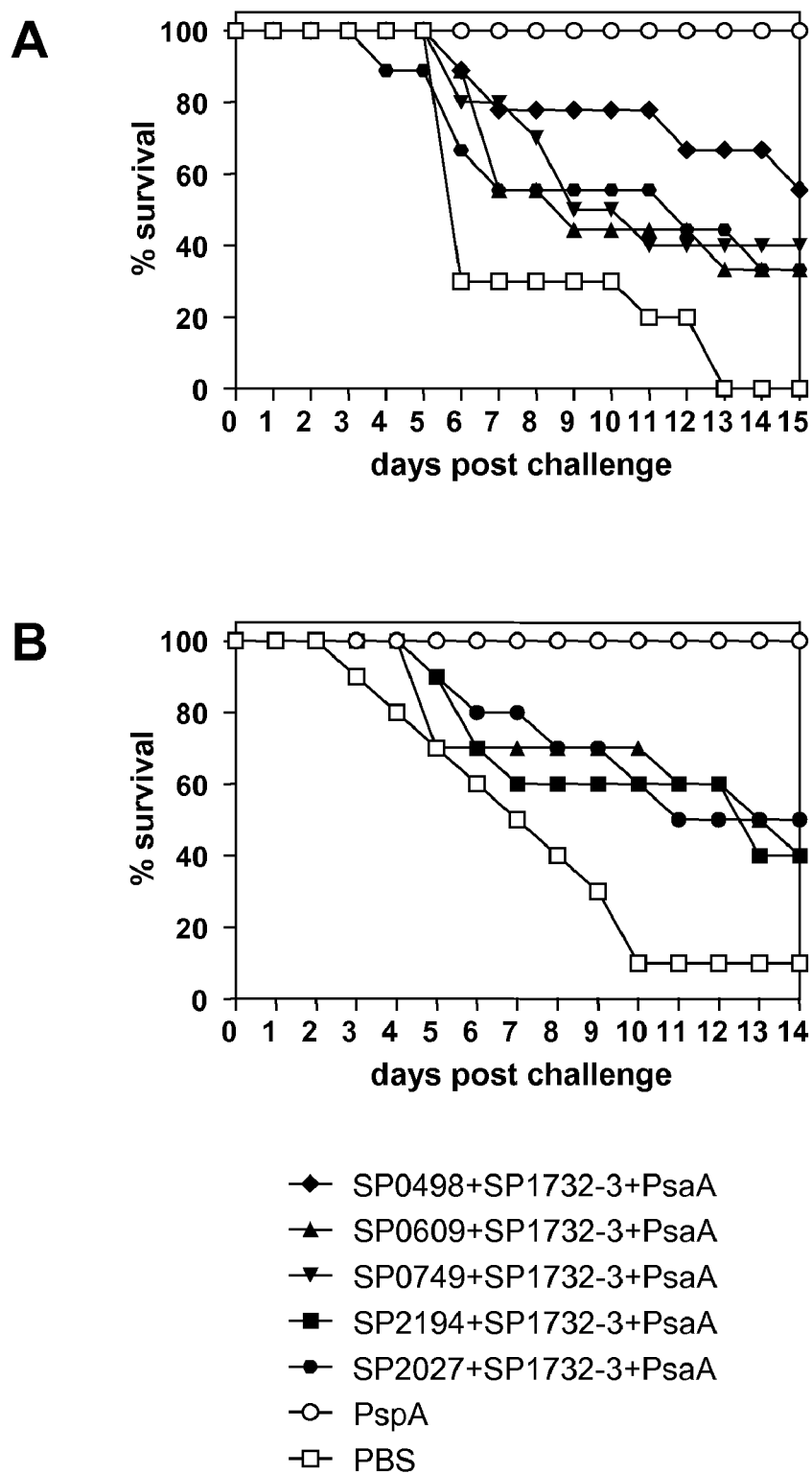

FIG. 3 shows the protection achieved by active immunization with a combination of selected *S. pneumoniae* antigens in combination with SP1732-3 and SP1650 (PsaA) in a mouse lethality model. C3H/HeN mice (10 mice per group) were immunized with a combination of recombinant antigens cloned from the serotype 4 *S. pneumoniae* strain TIGR4_IC and challenged with the serotype 6B strain Pj-1259. Survival was monitored for 2 weeks post-challenge. Mice were immunized subcutaneously with a mixture of 50 μg of each recombinant protein antigen adjuvanted with aluminum hydroxide (ALUM). Mice were then challenged intraperitoneally with $10^4$ cfu *S. pneumoniae* 6B. Adjuvant control mice were used as negative controls, while PspA (SP0117) served as positive control. Survival was monitored for 15 days post challenge and was depicted as percentage of total animals. (In A and B two different experiments are depicted).

Figure 4:
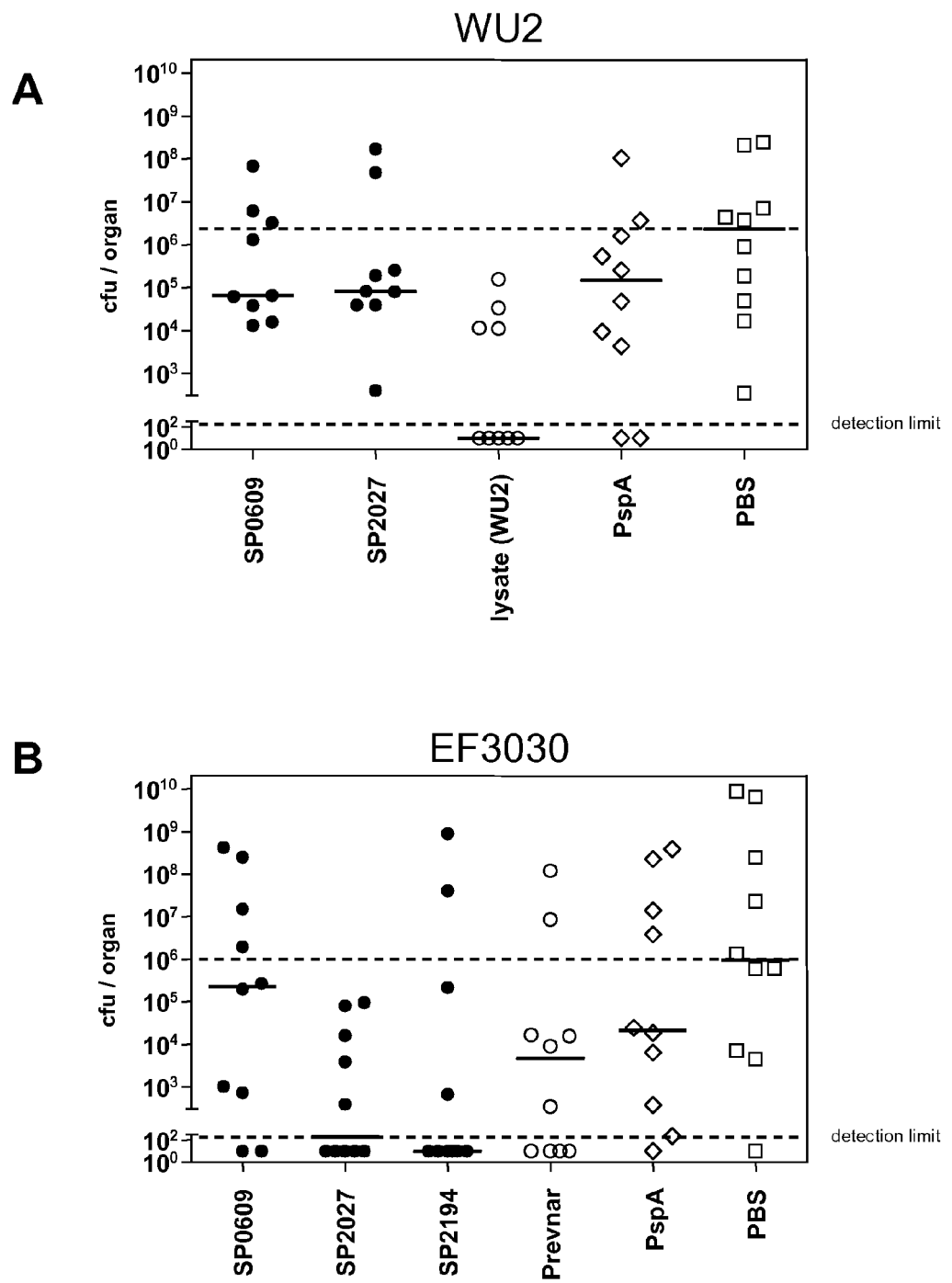

FIG. 4 shows the protection achieved by active immunization with selected *S. pneumoniae* antigens in a pneumonia model. CD-1 mice (10 mice per group) were subcutaneously immunized with 50 μg protein antigen adjuvanted with ALUM. (A) Mice were intranasally challenged with $10^5$ cfu *S. pneumoniae* WU2 (serotype 3). Adjuvant control mice were used as negative controls, while PspA (SP0117) and lysate (WU2) served as positive control. (B) Mice were intranasally challenged with $5\times10^7$ cfu *S. pneumoniae* EF3030. Adjuvant control mice were used as negative controls, while PspA (SP0117) and Prevnar served as positive controls. As read-out for pneumonia, lungs were removed at day 3 under sterile conditions, homogenized and cultures of lung homogenates were quantitatively plated on blood agar plates. Cfus per organ were determined for each individual mouse (10 mice/group).

Figure 5:
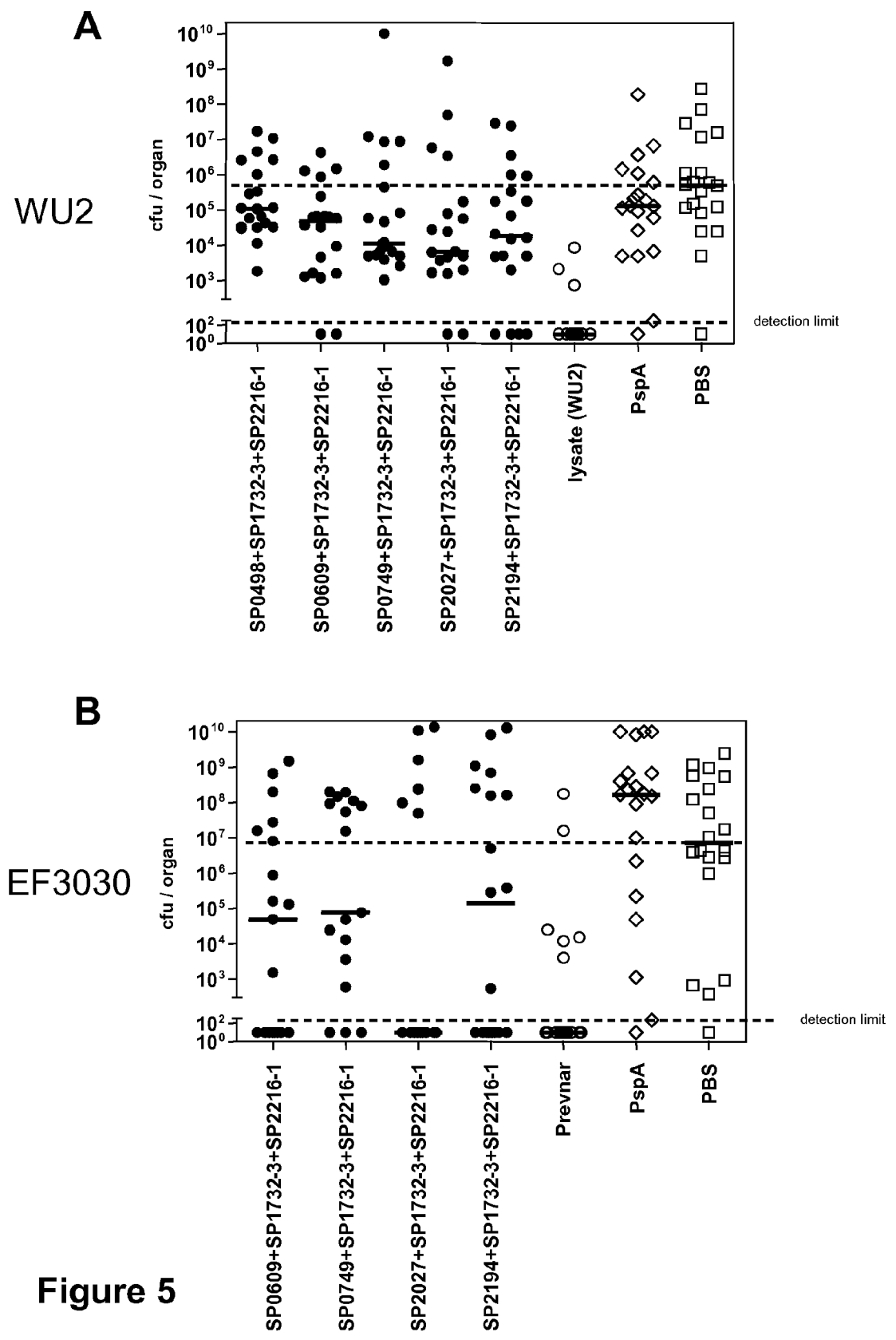

FIG. 5 shows the protection achieved by active immunization with a combination of selected *S. pneumoniae* antigens in combination with SP1732-3 and SP2216-1 in a pneumonia model. CD-1 mice (10 mice per group) were subcutaneously immunized with 50 μg protein antigen adjuvanted with ALUM. (A) Mice were intranasally challenged with $10^5$ cfu *S. pneumoniae* WU2 (serotype 3). Adjuvant control mice were used as negative controls, while PspA (SP0117) and lysate served as positive control. (B) Mice were intranasally challenged with $5\times10^7$ cfu *S. pneumoniae* EF3030 (serotype 19F). Adjuvant control mice were used as negative controls, while PspA (SP0117) and Prevnar served as positive controls. As read-out for pneumonia, lungs were removed at day 3 under sterile conditions, homogenized and cultures of lung homogenates were quantitatively plated on blood agar plates. Cfus per organ were determined for each individual mouse (10 mice/group).

Figure 6:
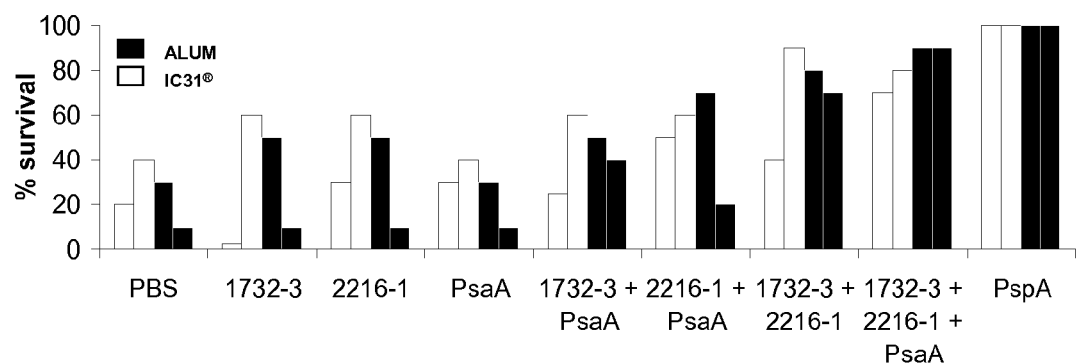
Figure 6:
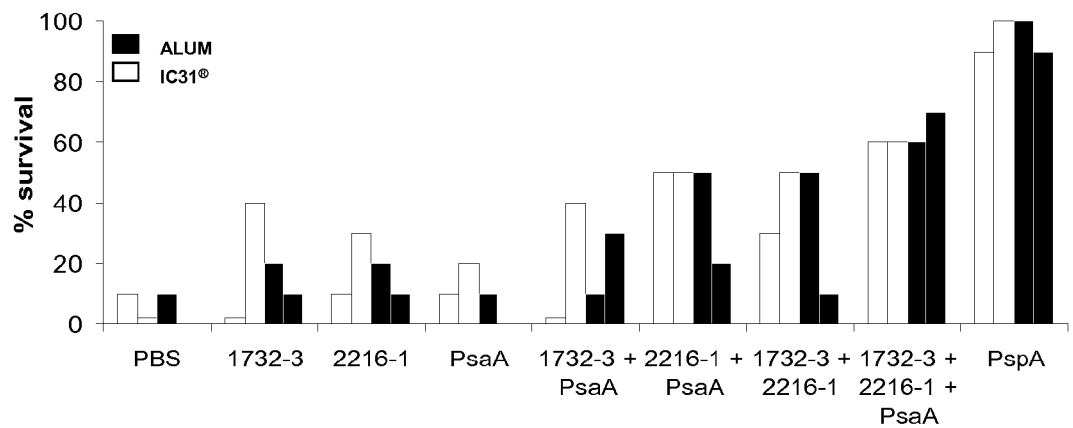

FIG. 6 shows the protection achieved by active immunization with selected *S. pneumoniae* antigens in a mouse lethality model. C3H/HeN mice (10 mice per group) were immunized with recombinant antigens cloned from the TIGR4_IC or Pj-1259 *S. pneumoniae* strains and challenged with a serotype 6B strain Pj-1259. Survival was monitored for 14 days post-challenge. Mice were immunized subcutaneously with 50 μg SP2216-1, SP1732-3, PsaA or combinations of these antigens adjuvanted with either aluminum hydroxide (ALUM) or IC31® (100 nmol KLKLLLLLKLK; 4 nmol ODN1a ([dIdC] 13)). Mice were then challenged intraperitoneally with $10^4$ cfu *S. pneumoniae* 6B. Adjuvant control mice were used as negative controls, while PspA (SP0117) served as positive control. Percentage of survival is depicted either on day 7 (A) or on day 14 (B). Two independent experiments using aluminum hydroxide (black bars) or two independent experiments using IC31® (white bars) as adjuvant are depicted.

Figure 7:
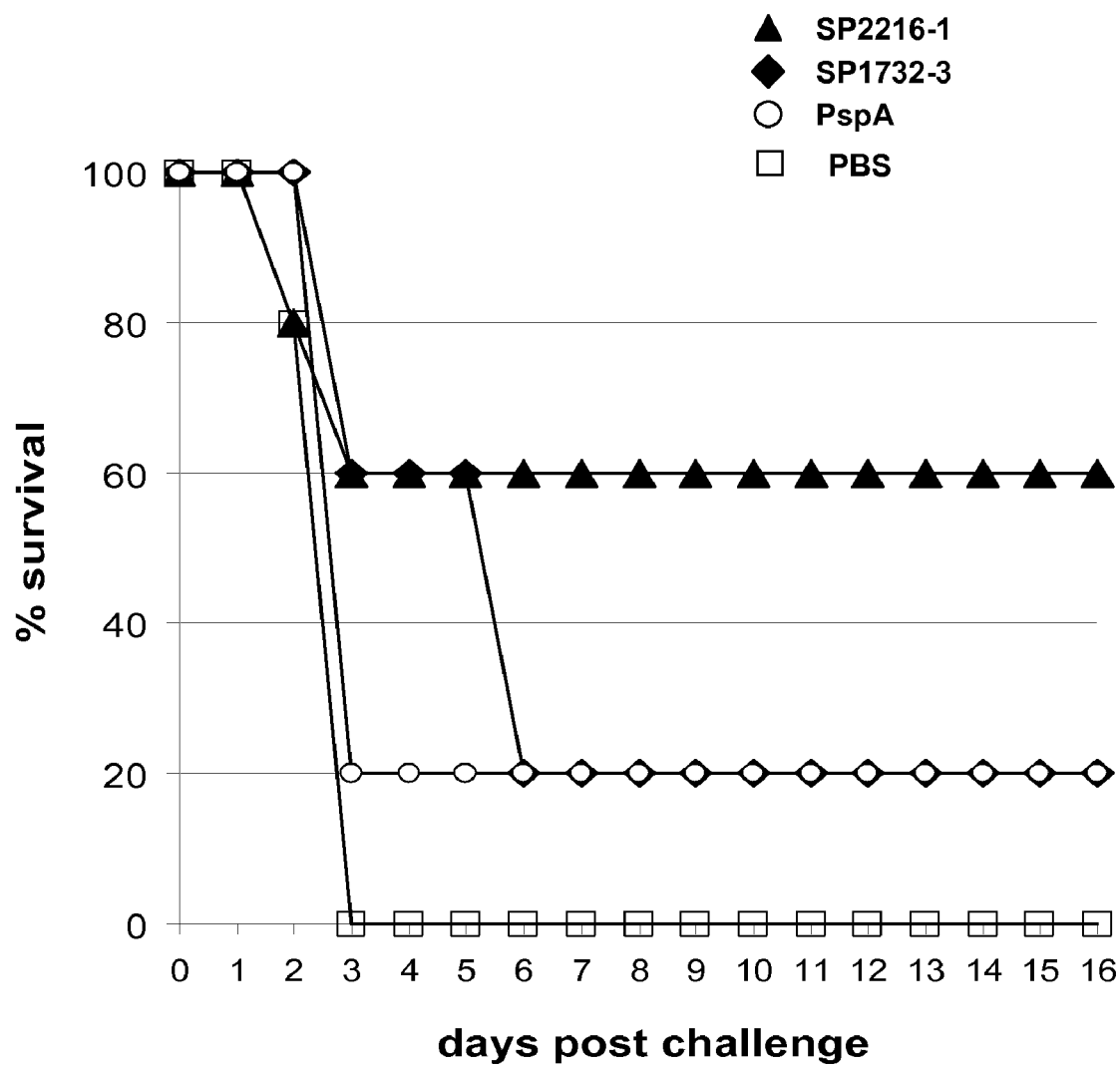

FIG. 7 shows the protection achieved by active immunization with SP1732-3 and SP2216-1 in an intranasal mouse sepsis model. NMRI mice (10 mice per group) were subcutaneously immunized with 50 μg protein antigen adjuvanted with CFA/IFA. Mice were intranasally challenged with $5\times10^6$ cfu *S. pneumoniae* 6301 (serotype 1). Adjuvant control mice were used as negative controls, while PspA (SP0117) served as positive control. Survival was monitored for 16 days post challenge and was depicted as percentage of total animals.

Figure 8:
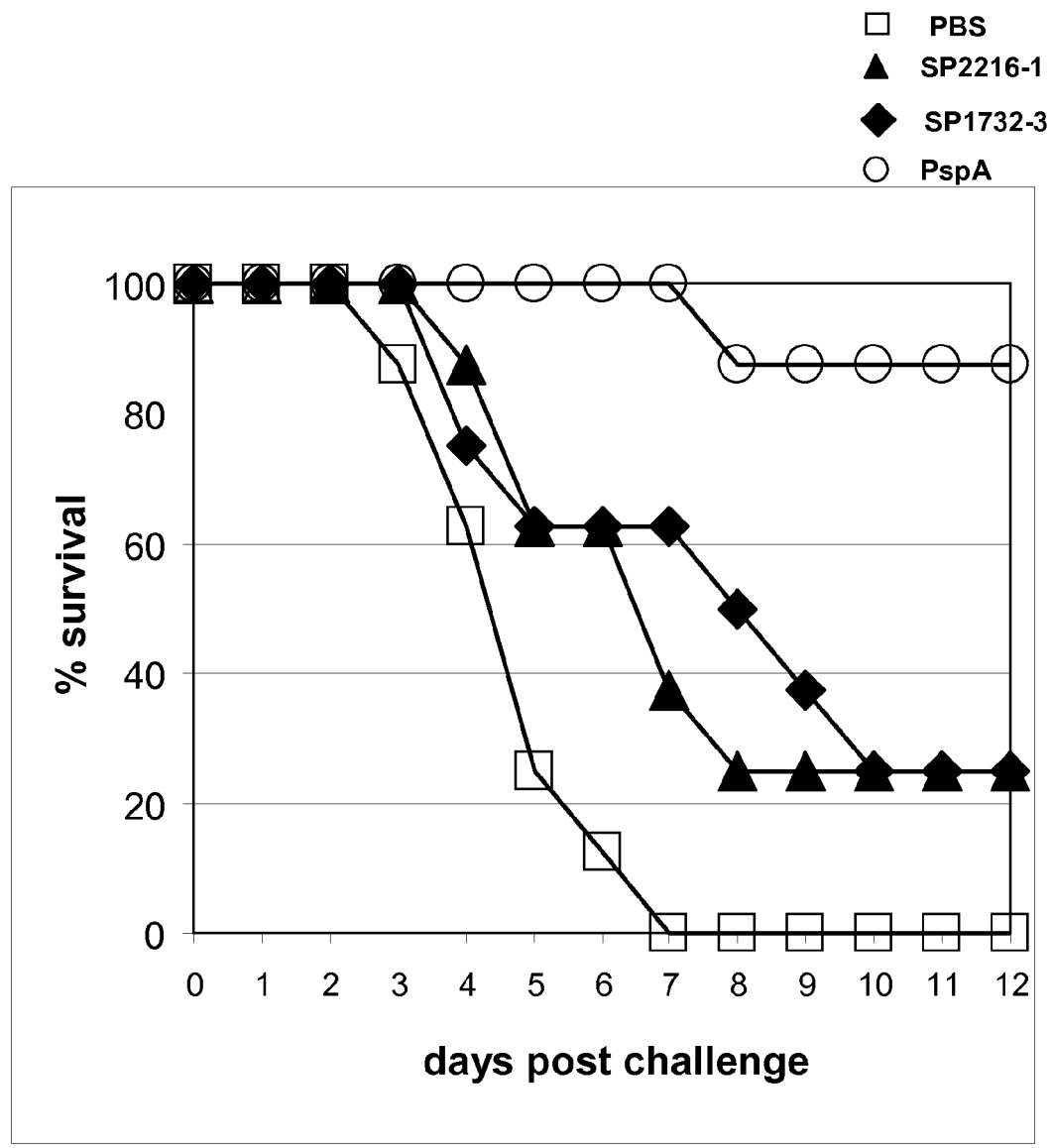

FIG. 8 shows the protection achieved by active immunization with SP1732-3 and SP2216-1 in an intravenous mouse sepsis model. CBA/N mice (10 mice per group) were subcutaneously immunized with 50 μg protein antigen adjuvanted with CFA/IFA. Mice were intravenously challenged with $5\times10^4$ cfu *S. pneumoniae* TIGR4_DB (serotype 4). Adjuvant control mice were used as negative controls, while PspA (SP0117) served as positive control. Survival was monitored for 12 days post challenge and was depicted as percentage of total animals.

Figure 9:
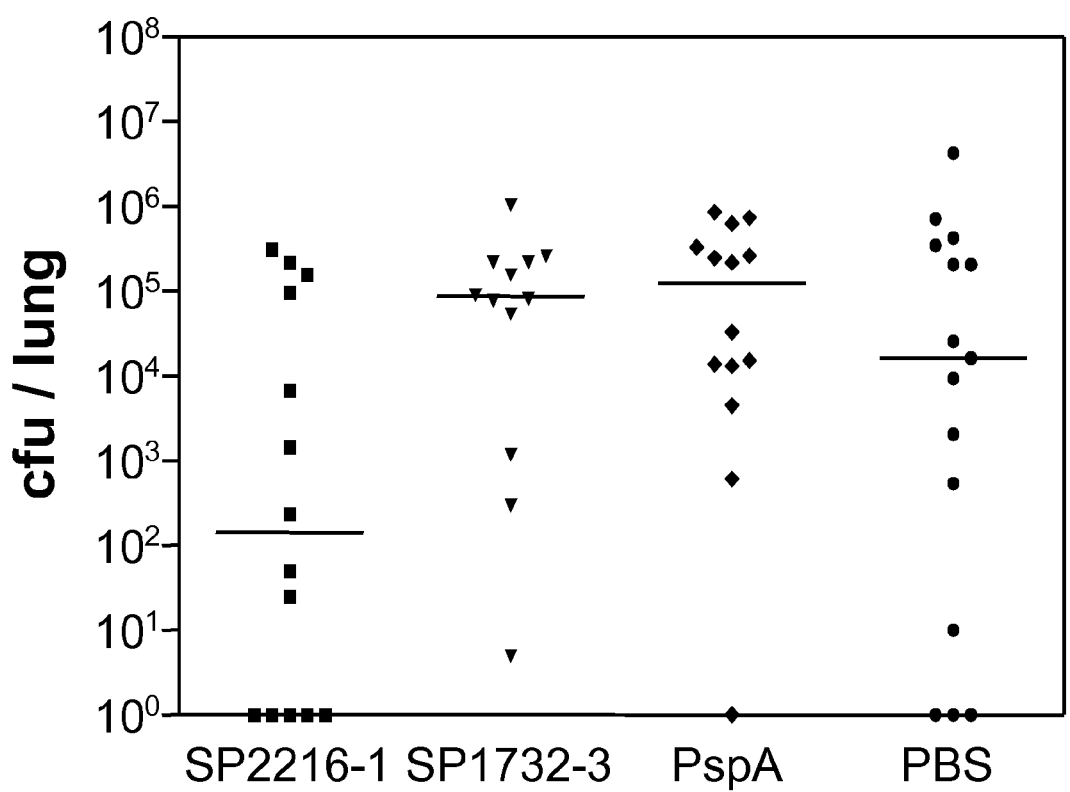

FIG. 9 shows the protection achieved by active immunization with SP1732-3 and SP2216-1 in a pneumonia model. CBA/N mice (10 mice per group) were subcutaneously immunized with 50 μg protein antigen adjuvanted with CFA/IFA. Mice were intravenously challenged with $10^7$ cfu *S. pneumoniae* EF3030 (serotype 19F). Adjuvant control mice were used as negative controls, while PspA (SP0117) served as positive control. As read-out for pneumonia, lungs were removed at day 6 after challenge under sterile conditions, homogenized and cultures of lung homogenates were quantitatively plated on blood agar plates. Cfus per organ were determined for each individual mouse (5-10 mice/group).

Figure 10:
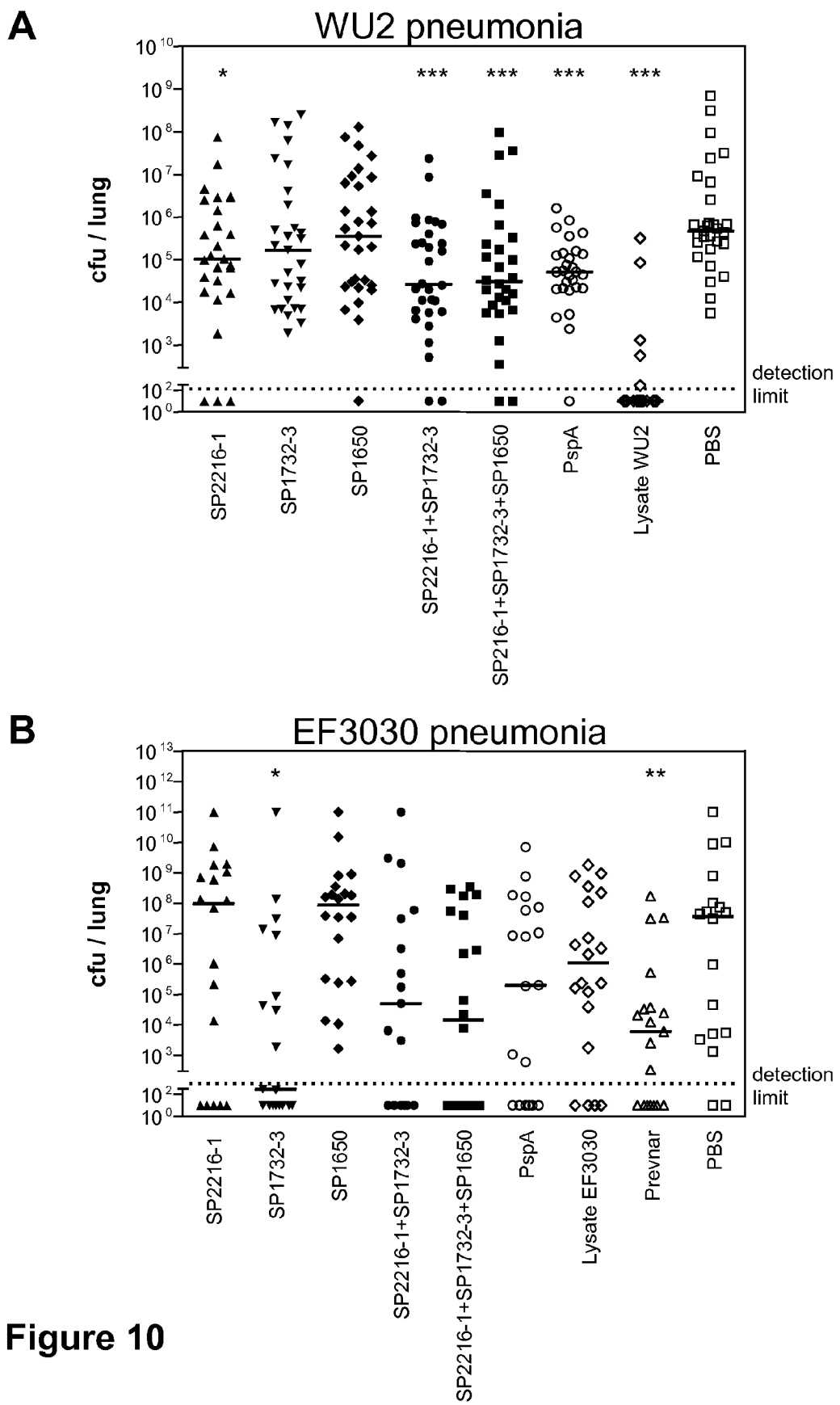

FIG. 10 shows the protection level achieved by active immunization with SP1732-3, SP2216-1 and SP1650 (PsaA) as well as combinations of SP1732-3, SP2216-1 (and SP1650) in a pneumonia model. CD-1 mice (10 mice per group) were subcutaneously immunized with 50 μg protein antigen adjuvanted with aluminum hydroxide (ALUM). Mice were intranasally challenged with (A) $10^5$ cfu *S. pneumoniae* WU2 (serotype 3) or (B) $5\times10^7$ cfu *S. pneumoniae* EF3030 (serotype 19F). Adjuvant control mice were used as negative controls, while PspA (SP0117), Prevnar, and/or lysate served as positive controls. As read-out for pneumonia, lungs were removed at day 3 after challenge under sterile conditions, homogenized and cultures of lung homogenates were quantitatively plated on blood agar plates. Cfus per organ were determined for each individual mouse. A summary of 2 or 3 experiments is shown (10 mice/group/experiment). Statistical significance (Mann-Whitney two sample rank test) is indicated with star(s).

Figure 11:
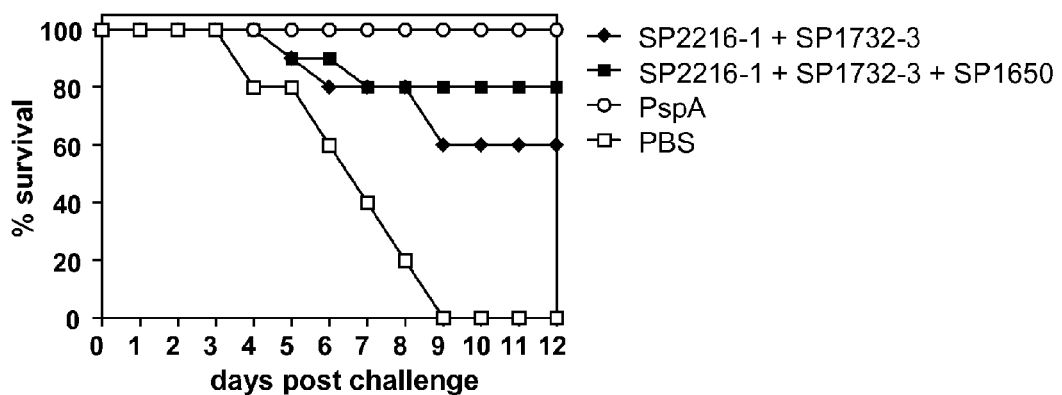
Figure 11:
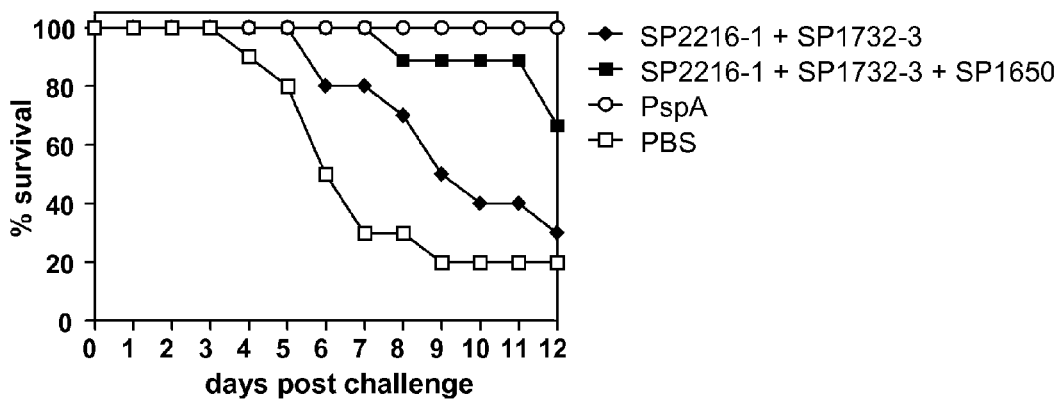

FIG. 11 shows the protection level achieved by active immunization with the combination of SP1732-3 and SP2216-1 or with combinations of SP1732-3, SP2216-1 and SP1650 (PsaA) in a mouse lethality model. C3H/HeN mice (10 mice per group) were immunized (A) subcutaneously or (B) intramuscularly with the respective combination of recombinant antigens adjuvanted with ALUM. Mice were intraperitoneally challenged with $10^4$ cfu S. pneumoniae 6B. Adjuvant control mice were used as negative controls, while PspA (SP0117) served as positive control. Survival was monitored for 12 days post challenge and was depicted as percentage of total animals.

Figure 12:
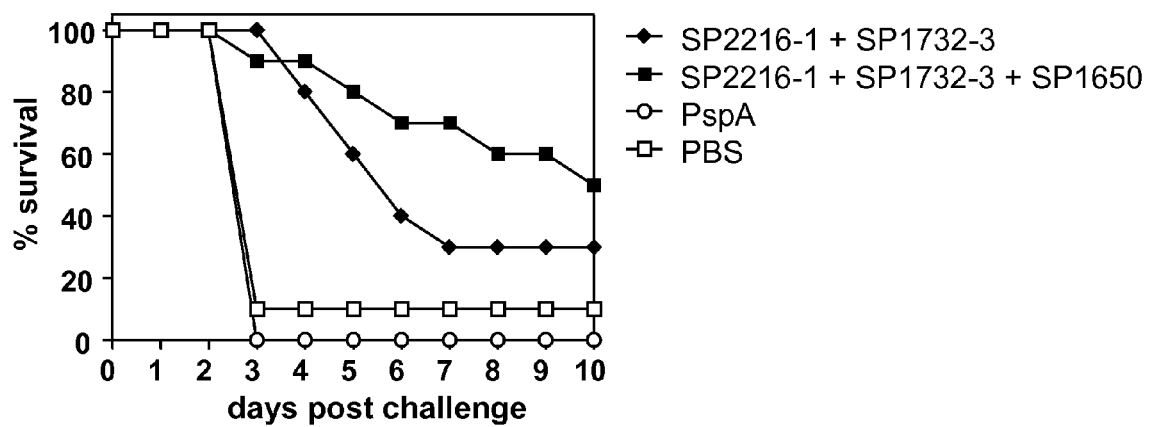

FIG. 12 shows the protection level achieved by active immunization with the combination of SP1732-3 and SP2216-1 or with combinations of SP1732-3, SP2216-1 and SP1650 (PsaA) in an intranasal mouse sepsis model. NMRI mice (10 mice per group) were subcutaneously immunized with 50 μg protein antigen adjuvanted with ALUM. Mice were intranasally challenged with $5 \times 10^6$ cfu S. pneumoniae 6301 (serotype 1). Adjuvant control mice were used as negative controls, while PspA (SP0117) served as positive control. Survival was monitored for 10 days post challenge and was depicted as percentage of total animals.

EXAMPLES

Example 1

Cloning and Expression of Recombinant Pneumococcal Antigens, their Sequence Analyses and Identification of Conserved Antigens Experimental Procedures Cloning of genes/DNA fragments: The gene/DNA fragment of interest was amplified from genomic DNA of the S. pneumoniae serotype 6B strain Pj-1259 or serotype 4 strain TIGR4_IC by PCR using gene specific primers. Apart from the gene specific part, the primers had restriction sites that aided in a directional cloning of the amplified PCR product. The gene annealing (specific) part of the primer ranged between 15-30 bases in length. The PCR products obtained were digested with the appropriate restriction enzymes and cloned into the pET28b (+) vector (Novagen) for His-tagged proteins. The constructs are listed in Table 1. Once the recombinant plasmid was confirmed to contain the gene of interest, E. coli BL21 Star® cells (Invitrogen) that served as expression host were transformed.

TABLE 1

List of genes selected for expression.

| Construct | Gene | Strain | Vector | RE | aa (start/stop) | nt (start/stop) | Seq ID (aa, nt) |
|---|---|---|---|---|---|---|---|
| 1 | SP0498 | TIGR4_IC | pET28b(+) | BamHI/NotI | 881-1658 | 2641-4974 | 1, 9 |
| 2 | SP0609 | TIGR4_IC | pET28b(+) | NcoI/NotI | 1-254* | 1-762 | 2, 10 |
| 3 | SP0749 | TIGR4_IC | pET28b(+) | NcoI/NotI | 28-386 | 82-1158 | 3, 11 |
| 4 | SP2027 | TIGR4_IC | pET28b(+) | NcoI/XhoI | 2-136 | 4-408 | 4, 12 |
| 5 | SP2194 | TIGR4_IC | pET28b(+) | NcoI/NotI | 2-810** | 4-2430 | 5, 13 |
| 6 | SP2216-1 | TIGR4_IC | pET28b(+) | NcoI/NotI | 28-278 | 82-834 | 6, 14 |
| 7 | SP1732-3 | Pj-1259 | pET28b(+) | NcoI/XhoI | 345-659 | 1033-1977 | 7, 15 |
| 8 | SP1650 (PsaA) | Pj-1259 | pET28b(+) | NcoI/XhoI | 21-309 | 61-927 | 8, 16 |

The nomenclature and the numbering of the genes is derived from the published genome of S. pneumoniae TIGR4_Tettelin. The restriction sites (RE) used for cloning and the position (start/stop) of the amplicons are indicated for each construct.
*The residue Serine at position 50 relative to the native protein was changed to a Proline according to the sequence confirmation of the expression construct.
**The residue Glutamic acid at position 9 relative to the native protein was changed to a Glycine according to the sequence confirmation of the expression construct.
Both mutations could be due to PCR amplification or be mutations in the particular TIGR4_IC strain used for PCR amplification.

Expression and Purification of Proteins:

E. coli BL21 Star® cells harboring the recombinant plasmid were grown into log phase in the required culture volume. Once an $OD_{600nm}$ of 0.6 was reached the culture was induced with 0.5 mM IPTG for 3 hours at 37° C. The cells were harvested by centrifugation, lysed by a combination of the freeze-thaw method followed by disruption of cells with 'Bug-Buster®, (Novagen). The lysate was separated by centrifugation into soluble (supernatant) and insoluble (pellet) fractions. Depending on the location of the protein different purification strategies were applied.

A) If the His-tagged protein was in the soluble fraction, protein purification was done by binding the supernatant to Ni-Sepharose beads (Ni-Sepharose™ 6 Fast Flow, GE Healthcare). Due to the presence of the hexa Histidine (6×HIS) at the C terminus of the expressed protein, it bound to the Ni-Sepharose while the other contaminating proteins were washed from the column by wash buffer. The protein was eluted by 500 mM Imidazole in 20 mM $NaH_2PO_4$, 0.5 mM NaCl buffer at pH 7.4. The eluate was concentrated, assayed by Bradford or BCA for protein concentration and checked by SDS-PAGE and Western blot.

B) If the protein was present in the insoluble fraction the pellet was solubilized in suitable buffer containing 8 M Urea and applied onto the Ni-NTA column under denaturing conditions (in buffer containing 8 M Urea) using the same materials and procedure as mentioned above. Contaminating proteins were washed from the column by wash buffer without urea. Refolding of the His-tagged protein was performed while the protein was immobilized on the Ni-NTA matrix. After renaturation, proteins were eluted by the addition of 500 mM Imidazole. The eluate was dialyzed to remove traces of urea and concentrated if the volume was large, checked by SDS-PAGE and measured by the Bradford or BCA method.

Preparation of Streptococcal Genomic DNA 5 ml Todd-Hewitt Broth medium were inoculated with the respective strain of S. pneumoniae from a frozen stab and grown without shaking at 37° C. overnight. 4 ml of the culture were then harvested by centrifuging at 13,000 rpm in a biofuge fresco (Heraeus) for 5 min and the supernatant was removed. DNA was isolated from the bacterial cell pellets following the protocol of Wizard® Genomic DNA Purification Kit (Promega). The DNA pellets were finally dried on air and dissolved in 70 µl ddH$_2$O.

PCR Amplification of Pneumococcal Antigens

PCR was performed on a series of independent *S. pneumonia* isolates (Table 2) with primers specific for the gene of interest. Oligonucleotide sequences as primers were designed for the three vaccine candidates using the public program Primer3. Oligonucleotide sequences as primers for PCR were designed for the selected antigens in order to be able to amplify the full gene. Genomic DNA of all *S. pneumonia* strains was prepared as described above. PCR was performed in a reaction volume of 25 µl using Taq polymerase (1 U), 200 nM dNTPs, 10 pMol of each oligonucleotide, app. 10 to 20 ng DNA and a kit according to the manufacturers instructions (Invitrogen, The Netherlands). As standard, 30 cycles (1×: 5 min. 95° C., 30×: 30 sec. 95° C., 30 sec. 56° C., 120 sec. 72° C., 1×: 4 min. 72° C.) were performed, unless conditions had to be adapted for individual primer pairs. The PCR amplification was performed in a Biometra T3 Thermocycler.

All negative PCR reactions in the first amplification round were repeated applying the following conditions:
5 µl genomic DNA (diluted 1:33 in ddH$_2$O; approx. 10 to 20 ng)
2.5 µl 10× buffer (Invitrogen Taq Polymerase I)
1.0 µl 50 mM MgCl$_2$
2.5 µl 2 mM dNTPs
each 1 µl 10 pM oligonucleotides
0.2 µl Invitrogen Taq Polymerase I (5 U/µl)
11.8 µl ddH$_2$O The DNA samples were subsequently visualized by electrophoresis on a 1% agarose gel and stained with ethidium bromide (EtBr). If possible, the oligonucleotide design was performed to incorporate all regions, which were identified as antigenic. In cases, where the gene was smaller than 1,000 bp, the entire gene was used for the analysis. All oligonucleotides are listed in Table 3.

The two point mutations mentioned in Table 1 (marked with * and **) may be due to PCR amplification. Accordingly, the respective sequences of the protective peptides of SP0609 and SP2194 without these point mutations are shown as SEQ ID NO: 17 and 18, respectively.

TABLE 2

*S. pneumoniae* strains utilized for the present study.

| No. | Strain | Serotype |
|---|---|---|
| 1 | Pj-102-59 | 18C |
| 2 | Pj-102-62 | 23F |

TABLE 2-continued

*S. pneumoniae* strains utilized for the present study.

| No. | Strain | Serotype |
|---|---|---|
| 3 | Pj-102-70 | 23F |
| 4 | Pj-102-77 | 3 |
| 5 | Pj-102-93 | 19F |
| 6 | Pj-102-94 | 7F |
| 7 | Pj-102-98 | 6B |
| 8 | Pj-102-113 | 4 |
| 9 | Pj-102-148 | 3 |
| 10 | Pj-102-160 | 9V |
| 11 | Pj-102-161 | 9V |
| 12 | Pj-102-163 | 7F |
| 13 | Pj-102-174 | 4 |
| 14 | Pj-102-228 | 19F |
| 15 | Pj-102-386 | 6B |
| 16 | Pj-102-468 | 18C |
| 17 | Pj-1344 | 1 |
| 18 | Pj-1364 | 14 |
| 19 | Pj-1484 | 14 |
| 20 | Pj-1490 | 1 |
| 21 | Pj-1228 | 1 |
| 22 | Pj-1229 | 19F |
| 23 | Pj-1230 | 3 |
| 24 | Pj-1231 | 8 |
| 25 | Pj-1232 | 19A |
| 26 | Pj-1233 | 19A |
| 27 | Pj-1234 | 14 |
| 28 | Pj-1236 | 9N |
| 29 | Pj-1237 | 7F |
| 30 | Pj-1241 | 6A |
| 31 | Pj-1242 | 18C |
| 32 | Pj-1244 | 4 |
| 33 | Pj-1248 | 23F |
| 34 | Pj-1250 | 6B |
| 35 | Pj-1255 | 9V |
| 36 | Pj-1262 | 9N |
| 37 | Pj-1279 | 6A |
| 38 | Pj-1283 | 33F |
| 39 | Pj-1284 | 17F |
| 40 | Pj-1291 | 22F |
| 41 | Pj-1297 | 35A |
| 42 | Pj-1298 | 8 |
| 43 | Pj-1300 | 22F |
| 44 | Pj-1322 | 35F |
| 45 | Pj-1330 | 17F |
| 46 | Pj-1345 | 12F |
| 47 | Pj-1347 | 12F |
| 48 | Pj-1369 | 35F |
| 49 | Pj-1386 | 33F |
| 50 | PBI-71 | 5 |
| 51 | I-33_Andersson | 3 |
| 52 | Pj-1291_Andersson | 22F |
| 53 | TIGR4_DB* | 4 |
| 54 | TIGR4_IC* | 4 |

*The TIGR4_DB (Ren, B., et al. (2003), Infect Immun. 71: 75-85) and TIGR4_IC strains are distinct from the TIGR4_Tettelin strain (Tettelin et al. (2001), Science 293: 498-506) used for sequence comparison, as publicly available in genomic databases.

TABLE 3

Oligonucleotides used for sequence conservation analyses. Shown are the ORF and primer names, SEQ ID NOs, orientation of the primer relative to the gene, the sequence, and the position relative to the gene. Oligonucleotides were used for both PCR amplification of the gene or gene fragment and subsequent sequence analyses.

| ORF | Primer name (Seq ID) | Orientation | Sequence | Position relative to gene |
|---|---|---|---|---|
| SP0498 | ICC5875 (Seq ID 19) | sense | TGTGATTATCATGGTTCTAGAGTTTGA | -92 to -65 |
|  | ICC6198 (Seq ID 20) | sense | TGCAAACAGTTATTGGTTTTTGTC | -138 to -114 |

TABLE 3-continued

Oligonucleotides used for sequence conservation analyses. Shown are the ORF and primer names, SEQ ID NOs, orientation of the primer relative to the gene, the sequence, and the position relative to the gene. Oligonucleotides were used for both PCR amplification of the gene or gene fragment and subsequent sequence analyses.

| ORF | Primer name (Seq ID) | Orientation | Sequence | Position relative to gene |
|---|---|---|---|---|
| | ICC5876 (Seq ID 21) | antisense | GGATGGTTTACCTTAGCAGCA | 1079 to 1100 |
| | ICC5877 (Seq ID 22) | sense | TGATGGCTATTTCATCAACCA | 986 to 1007 |
| | ICC5878 (Seq ID 23) | antisense | CGCTTCTTGGGCATTTTTAAG | 2157 to 2178 |
| | ICC5879 (Seq ID 24) | sense | CGAGCATGAAGGTGCTGTAA | 2045 to 2065 |
| | ICC5880 (Seq ID 25) | antisense | CCACCTCTAAGGTCCAAATCC | 3233 to 3254 |
| | ICC5881 (Seq ID 26) | sense | CCTAGCAGTTTCCGTTCCAA | 3143 to 3163 |
| | ICC5882 (Seq ID 27) | antisense | CACTTGCTTGAACACGCTCT | 4205 to 4225 |
| | ICC5883 (Seq ID 28) | sense | CAGAGTCTAAAAGATCTGGTTGCTT | 4080 to 4105 |
| | ICC5884 (Seq ID 29) | antisense | TTTGCCATGTTACAAAAACTCC | 5055 to 5077 |
| SP0609 | ICC5885 (Seq ID 30) | sense | TTGACAATCCAAGCGAACCT | −116 to −96 |
| | ICC5886 (Seq ID 31) | antisense | AAGAGGAAACCATTGAAAAATTG | 822 to 845 |
| SP0749 | ICC5887 (Seq ID 32) | sense | TCATCGAAAAAGTTCAAGGAAAA | −90 to −67 |
| | ICC5888 (Seq ID 33) | antisense | CGTTGACGCAGTTTGAAGAG | 1233 to 1253 |
| | ICC5889 (Seq ID 34) | sense | TAGCGAACGCTACAAAAGCA | 373 to 393 |
| SP2027 | ICC5890 (Seq ID 35) | sense | CCAGACCCTTGGTATACAGGA | −97 to −76 |
| | ICC5891 (Seq ID 36) | antisense | TTGCTTGGAAGAGGGATTTG | 480 to 500 |
| SP2194 | ICC5892 (Seq ID 37) | sense | CTTTGGATCGCGTTTTAGGA | −93 to −73 |
| | ICC5893 (Seq ID 38) | antisense | GCCAAGGCTGGTTTCAAGAT | 975 to 995 |
| | ICC5894 (Seq ID 39) | sense | TGAAGAAGATGGCCAAGTCA | 881 to 901 |
| | ICC5895 (Seq ID 40) | antisense | AGACACCGTCATCCAGAACC | 1907 to 1927 |
| | ICC5896 (Seq ID 41) | sense | GGAGCTCCTCCAGGCTATGT | 1773 to 1793 |
| | ICC5897 (Seq ID 42) | antisense | GCGGCTAGCTGCCTAGTTT | 2500 to 2519 |

TABLE 3-continued

Oligonucleotides used for sequence conservation analyses. Shown are the ORF and primer names, SEQ ID NOs, orientation of the primer relative to the gene, the sequence, and the position relative to the gene. Oligonucleotides were used for both PCR amplification of the gene or gene fragment and subsequent sequence analyses.

| ORF | Primer name (Seq ID) | Orientation | Sequence | Position relative to gene |
|---|---|---|---|---|
| | ICC6004 (Seq ID 43) | antisense | AACGATCCGTGGTTTTCATC | 2613 to 2633 |
| | ICC6279 (Seq ID 44) | antisense | GATAGAGCTGACGTGGTTTGAAGAGATT | 2550 to 2578 |

Sequence Analyses of S. pneumoniae Genes

In order to determine the sequence of an antigen from diverse S. pneumoniae strains, PCR was performed with primers specific for the gene of interest as described above. S. pneumoniae strains used for these analyses are shown in Table 2. Sequencing was performed with dedicated primers using the PCR products as templates. The sequences of the oligonucleotides are listed in Table 3. Genomic DNA of all S. pneumoniae strains was prepared as described above. PCR was performed in a reaction volume of 25 µl as described above, unless conditions had to be adapted for individual primer pairs. PCR samples were sequenced with the oligonucleotides as listed in Table 3. Sequencing was performed at Agowa (Germany).

Results

The Selected Pneumococcal Antigens are Highly Conserved

The PCR and sequencing of the 5 selected genes was performed as described under Methods. Table 2 shows the strains used for sequencing, while Table 3 lists the oligonucleotides employed for the PCR and sequencing analyses. Overall, Table 9 lists all strains for which sequences of the respective genes were determined. Those strains have been compared to the Reference strain S. pneumoniae TIGR4 (Tettelin et al. (2001), Science 293: 498-506); herein designated as TIGR4_Tettelin. Accordingly, the Reference positions in Tables 4 to 8 refer to the respective position of S. pneumoniae TIGR4_Tettelin.

Sequence Analyses of SP0498

Sequences were obtained from 51 pneumococcal strains. The level of amino acid sequence identity ranged from 98.2% to 100% as compared to the sequence of SP0498 from S. pneumoniae TIGR4_Tettelin. Table 4 lists all 119 amino acid positions which showed a distinct amino acid as compared to SP0498 from the Reference strain S. pneumoniae TIGR4_Tettelin.

TABLE 4

Gene conservation of SP0498.

| Reference position | Alignment position | Amino acid in Reference | AA change[1] | AA change[2] | Strains with respective change[1] | Strains with respective change[2] |
|---|---|---|---|---|---|---|
| 32 | 32 | A | V | | Pj-1364, Pj-1233, Pj-1234 | |
| 47 | 47 | G | R | | Pj-102-94, Pj-102-163, Pj-1237 | |
| 50 | 50 | T | P | | Pj-102-59, Pj-1231, Pj-1298, Pj-1386 | |
| 61 | 61 | T | I | | Pj-102-77 | |
| 69 | 69 | E | K | | Pj-102-161 | |
| 73 | 73 | A | T | | Pj-102-77, Pj-102-93, Pj-102-160, Pj-1364, Pj-1484, Pj-1233, Pj-1234, Pj-1248, Pj-1255, Pj-1297, Pj-1322, Pj-1330, Pj-1369 | |
| 81 | 81 | A | — | | Pj-1236, Pj-1262, Pj-1300 | |
| 82 | 82 | E | — | | Pj-1236, Pj-1262, Pj-1300 | |
| 83 | 83 | G | — | A | Pj-1236, Pj-1262, Pj-1300 | Pj-1230 |
| 84 | 84 | V | — | | Pj-1236, Pj-1262, Pj-1300 | |
| 85 | 85 | A | — | | Pj-1236, Pj-1262, Pj-1300 | |
| 86 | 86 | I | — | T | Pj-1236, Pj-1262, Pj-1300 | Pj-102-77, Pj-102-93, Pj-102-94, Pj-102-148, Pj-102-160, Pj-102-163, Pj-1364, Pj-1484, Pj-1229, Pj-1230, Pj-1233, Pj-1234, Pj-1237, Pj-1241, Pj-1248, Pj-1255, Pj-1279, Pj-1291, Pj-1297, Pj-1322, Pj-1330, Pj-1369, PBI-71 |

TABLE 4-continued

Gene conservation of SP0498.

| Reference position | Alignment position | Amino acid in Reference | AA change[1] | AA change[2] | Strains with respective change[1] | Strains with respective change[2] |
|---|---|---|---|---|---|---|
| 87 | 87 | A | — | | Pj-1236, Pj-1262, Pj-1300 | |
| 88 | 88 | S | — | | Pj-1236, Pj-1262, Pj-1300 | |
| 89 | 89 | E | — | | Pj-1236, Pj-1262, Pj-1300 | |
| 90 | 90 | T | — | | Pj-1236, Pj-1262, Pj-1300 | |
| 91 | 91 | A | — | | Pj-1236, Pj-1262, Pj-1300 | |
| 92 | 92 | S | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 93 | 93 | P | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 94 | 94 | A | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 95 | 95 | S | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 96 | 96 | N | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 97 | 97 | E | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 98 | 98 | A | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 99 | 99 | A | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 100 | 100 | T | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 101 | 101 | T | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 102 | 102 | E | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |

TABLE 4-continued

Gene conservation of SP0498.

| Reference position | Alignment position | Amino acid in Reference | AA change[1] | AA change[2] | Strains with respective change[1] | Strains with respective change[2] |
|---|---|---|---|---|---|---|
| 103 | 103 | T | — | | Pj-102-59, Pj-102-77, Pj-102-93, Pj-102-160, Pj-1364, Pj-1484, Pj-1229, Pj-1231, Pj-1233, Pj-1236, Pj-1241, Pj-1248, Pj-1255, Pj-1262, Pj-1283, Pj-1297, Pj-1298, Pj-1300, Pj-1322, Pj-1330, Pj-1369, Pj-1386, PBI-71 | |
| 104 | 104 | A | — | | Pj-102-59, Pj-102-77, Pj-102-93, Pj-102-160, Pj-1364, Pj-1484, Pj-1229, Pj-1231, Pj-1233, Pj-1241, Pj-1248, Pj-1255, Pj-1283, Pj-1297, Pj-1298, Pj-1322, Pj-1330, Pj-1369, Pj-1386, PBI-71 | |
| 110 | 110 | A | T | | Pj-1279 | |
| 116 | 116 | A | V | | Pj-1229 | |
| 117 | 117 | S | G | | Pj-1364, Pj-1484, Pj-1229, Pj-1230, Pj-1233, Pj-1234, Pj-1236, Pj-1262, Pj-1300, PBI-71 | |
| 119 | 119 | V | A | | Pj-102-160, Pj-1255 | |
| 120 | 120 | V | I | | Pj-1241 | |
| 126 | 126 | A | V | | Pj-1279 | |
| 153 | 153 | A | E | | Pj-102-94, Pj-102-148, Pj-102-163, Pj-102-468, Pj-1229, Pj-1232, Pj-1237, Pj-1242, Pj-1347 | |
| 164 | 164 | P | S | | Pj-1279 | |
| 194 | 194 | A | V | | Pj-102-148 | |
| 225 | 225 | K | — | | Pj-102-160 | |
| 226 | 226 | V | — | | Pj-102-160 | |
| 227 | 227 | Q | — | | Pj-102-160 | |
| 228 | 228 | A | — | T | Pj-102-160 | Pj-102-148 |
| 229 | 229 | L | — | | Pj-102-160 | |
| 230 | 230 | S | — | | Pj-102-160 | |
| 231 | 231 | N | — | | Pj-102-160 | |
| 232 | 232 | T | — | | Pj-102-160 | |
| 233 | 233 | N | — | | Pj-102-160 | |
| 234 | 234 | S | — | | Pj-102-160 | |
| 235 | 235 | K | — | | Pj-102-160 | |
| 236 | 236 | A | — | | Pj-102-160 | |
| 324 | 324 | A | V | | Pj-1364 | |
| 348 | 348 | E | R | | Pj-1490 | |
| 359 | 359 | E | A | | Pj-102-77 | |
| 405 | 405 | A | V | | Pj-1369 | |
| 603 | 603 | D | V | | Pj-102-160, Pj-1229, Pj-1255 | |
| 641 | 641 | P | S | | Pj-102-62, Pj-102-70, Pj-102-160, Pj-1229, Pj-1255 | |
| 666 | 666 | D | A | | Pj-102-59, Pj-1364, Pj-1484, Pj-1231, Pj-1233, Pj-1234, Pj-1279, Pj-1283, Pj-1298, Pj-1386 | |
| 685 | 685 | E | K | | Pj-102-98, Pj-102-386, Pj-1250 | |
| 692 | 692 | Q | R | | Pj-1236, Pj-1262 | |
| 694 | 694 | N | H | | Pj-102-59 | |
| 750 | 750 | S | N | | Pj-1241, Pj-1297, Pj-1369 | |
| 800 | 836 | D | E | | Pj-1230, Pj-1236, Pj-1262, Pj-1300 | |
| 806 | 842 | K | Q | | Pj-1230, Pj-1236, Pj-1262, Pj-1300 | |
| 812 | 848 | K | R | | Pj-1230, Pj-1236, Pj-1262, Pj-1300 | |
| 826 | 862 | D | G | | Pj-1230, Pj-1236, Pj-1262, Pj-1300 | |
| 831 | 867 | K | D | | Pj-1230, Pj-1236, Pj-1262, Pj-1300 | |
| 869 | 905 | P | S | | Pj-102-468, Pj-1242, Pj-1291, Pj-1347 | |
| 907 | 943 | E | K | | Pj-1300 | |
| 924 | 960 | I | V | | Pj-1364, Pj-1484, Pj-1233, Pj-1234, Pj-1241, Pj-1297 | |
| 974 | 1010 | A | V | | Pj-1241 | |
| 989 | 1025 | A | S | | Pj-102-160, Pj-1229, Pj-1255, Pj-1369 | |
| 992 | 1028 | P | Q | | Pj-102-62, Pj-102-70 | |
| 1006 | 1042 | Q | P | | Pj-1364, Pj-1484, Pj-1234 | |
| 1007 | 1043 | T | I | | Pj-102-148, PBI-71 | |
| 1054 | 1090 | P | Q | | Pj-1233 | |
| 1142 | 1178 | Q | K | | Pj-102-160, Pj-1255 | |
| 1158 | 1194 | E | K | | Pj-1322 | |
| 1162 | 1198 | D | N | | Pj-102-148, Pj-1322 | |
| 1168 | 1204 | S | N | | Pj-102-59, Pj-1231, Pj-1283, Pj-1298, Pj-1386 | |
| 1170 | 1206 | D | N | | Pj-102-62, Pj-102-70 | |
| 1175 | 1211 | R | C | | Pj-102-148 | |
| 1205 | 1241 | T | I | | Pj-1322 | |

TABLE 4-continued

Gene conservation of SP0498.

| Reference position | Alignment position | Amino acid in Reference | AA change[1] | AA change[2] | Strains with respective change[1] | Strains with respective change[2] |
|---|---|---|---|---|---|---|
| 1213 | 1249 | H | R | | Pj-102-59, Pj-102-62, Pj-102-70, Pj-102-77, Pj-102-93, Pj-102-94, Pj-102-148, Pj-102-163, Pj-102-228, Pj-102-468, Pj-1344, Pj-1364, Pj-1484, Pj-1490, Pj-1230, Pj-1231, Pj-1232, Pj-1234, Pj-1236, Pj-1237, Pj-1241, Pj-1242, Pj-1262, Pj-1283, Pj-1291, Pj-1297, Pj-1298, Pj-1300, Pj-1322, Pj-1347, Pj-1386 | |
| 1219 | 1255 | V | F | | Pj-102-62, Pj-102-70, Pj-1230 | |
| 1220 | 1256 | S | N | | Pj-102-59, Pj-102-62, Pj-102-70, Pj-102-77, Pj-102-93, Pj-102-94, Pj-102-148, Pj-102-163, Pj-102-228, Pj-102-468, Pj-1344, Pj-1364, Pj-1484, Pj-1490, Pj-1230, Pj-1231, Pj-1232, Pj-1233, Pj-1234, Pj-1236, Pj-1237, Pj-1241, Pj-1242, Pj-1262, Pj-1283, Pj-1291, Pj-1297, Pj-1298, Pj-1300, Pj-1322, Pj-1347, Pj-1386 | |
| 1257 | 1293 | S | P | | Pj-102-59, Pj-102-62, Pj-102-70, Pj-102-77, Pj-102-93, Pj-102-94, Pj-102-148, Pj-102-160, Pj-102-163, Pj-102-228, Pj-102-468, Pj-1344, Pj-1364, Pj-1484, Pj-1490, Pj-1230, Pj-1231, Pj-1232, Pj-1233, Pj-1234, Pj-1236, Pj-1237, Pj-1241, Pj-1242, Pj-1255, Pj-1262, Pj-1279, Pj-1283, Pj-1291, Pj-1297, Pj-1298, Pj-1300, Pj-1322, Pj-1347, Pj-1386 | |
| 1261 | 1297 | E | A | | Pj-1347 | |
| 1262 | 1298 | A | V | | Pj-1241 | |
| 1277 | 1313 | H | R | | Pj-1230 | |
| 1279 | 1315 | T | I | | Pj-102-148, Pj-1279, Pj-1322, Pj-1347, PBI-71 | |
| 1291 | 1327 | K | E | | Pj-1369 | |
| 1306 | 1342 | T | K | | Pj-102-62, Pj-102-70, Pj-102-94, Pj-102-98, Pj-102-148, Pj-102-160, Pj-102-161, Pj-102-163, Pj-102-386, Pj-1344, Pj-1490, Pj-1230, Pj-1236, Pj-1237, Pj-1241, Pj-1250, Pj-1255, Pj-1262, Pj-1279, Pj-1284, Pj-1297, Pj-1300, Pj-1322, Pj-1347, PBI-71 | |
| 1319 | 1355 | V | A | | Pj-102-59, Pj-102-77, Pj-102-468, Pj-1364, Pj-1484, Pj-1231, Pj-1232, Pj-1233, Pj-1234, Pj-1242, Pj-1283, Pj-1291, Pj-1298, Pj-1386 | |
| 1324 | 1360 | A | D | | Pj-1322, Pj-1347 | |
| 1325 | 1361 | A | T | | Pj-1297 | |
| 1344 | 1380 | A | V | | Pj-1241, Pj-1322, Pj-1347 | |
| 1357 | 1393 | T | A | | Pj-102-59, Pj-102-62, Pj-102-70, Pj-102-77, Pj-102-94, Pj-102-98, Pj-102-148, Pj-102-161, Pj-102-163, Pj-102-386, Pj-102-468, Pj-1344, Pj-1490, Pj-1230, Pj-1231, Pj-1232, Pj-1233, Pj-1236, Pj-1237, Pj-1241, Pj-1242, Pj-1250, Pj-1262, Pj-1279, Pj-1283, Pj-1284, Pj-1291, Pj-1297, Pj-1298, Pj-1300, Pj-1322, Pj-1347, Pj-1386, PBI-71 | |
| 1359 | 1395 | A | T | | Pj-102-93, Pj-102-228 | |
| 1365 | 1401 | D | Y | | Pj-1232 | |
| 1375 | 1411 | P | S | | Pj-102-59, Pj-102-77, Pj-102-94, Pj-102-163, Pj-102-468, Pj-1231, Pj-1232, Pj-1237, Pj-1242, Pj-1283, Pj-1291, Pj-1298, Pj-1386 | |
| 1395 | 1431 | T | S | | Pj-102-163, Pj-102-174 | |
| 1428 | 1464 | L | W | | Pj-1236 | |
| 1436 | 1472 | D | A | | Pj-1230 | |
| 1464 | 1500 | E | G | | Pj-102-93, Pj-1291 | |
| 1469 | 1505 | A | T | | Pj-102-62, Pj-102-70, Pj-102-161, Pj-1232 | |
| 1477 | 1513 | V | I | | Pj-1233 | |
| 1482 | 1518 | P | S | | Pj-1232 | |
| 1507 | 1543 | T | K | | Pj-102-59, Pj-102-62, Pj-102-70, Pj- | |

TABLE 4-continued

Gene conservation of SP0498.

| Reference position | Alignment position | Amino acid in Reference | AA change[1] | AA change[2] | Strains with respective change[1] | Strains with respective change[2] |
|---|---|---|---|---|---|---|
| | | | | | 102-77, Pj-102-93, Pj-102-98, Pj-102-161, Pj-102-386, Pj-1344, Pj-1364, Pj-1484, Pj-1490, Pj-1230, Pj-1231, Pj-1233, Pj-1234, Pj-1241, Pj-1250, Pj-1283, Pj-1284, Pj-1291, Pj-1297, Pj-1298, Pj-1300, Pj-1322, Pj-1386, PBI-71 | |
| 1517 | 1553 | T | A | | Pj-102-59, Pj-102-62, Pj-102-70, Pj-102-77, Pj-102-93, Pj-102-94, Pj-102-98, Pj-102-148, Pj-102-160, Pj-102-161, Pj-102-163, Pj-102-228, Pj-102-386, Pj-102-468, Pj-1344, Pj-1364, Pj-1484, Pj-1490, Pj-1229, Pj-1230, Pj-1231, Pj-1232, Pj-1233, Pj-1234, Pj-1236, Pj-1237, Pj-1241, Pj-1242, Pj-1250, Pj-1255, Pj-1262, Pj-1279, Pj-1283, Pj-1284, Pj-1291, Pj-1297, Pj-1298, Pj-1300, Pj-1322, Pj-1347, Pj-1386, PBI-71 | |
| 1539 | 1575 | E | D | | Pj-1230 | |
| 1543 | 1579 | T | A | | Pj-102-59, Pj-102-62, Pj-102-70, Pj-102-77, Pj-102-94, Pj-102-98, Pj-102-148, Pj-102-160, Pj-102-161, Pj-102-163, Pj-102-386, Pj-102-468, Pj-1344, Pj-1364, Pj-1484, Pj-1490, Pj-1228, Pj-1229, Pj-1230, Pj-1231, Pj-1232, Pj-1233, Pj-1234, Pj-1236, Pj-1237, Pj-1242, Pj-1250, Pj-1255, Pj-1262, Pj-1279, Pj-1283, Pj-1284, Pj-1298, Pj-1322, Pj-1347, Pj-1386, PBI-71 | |
| 1570 | 1606 | N | K | | Pj-1279, Pj-1291 | |
| 1601 | 1637 | V | I | | PBI-71 | |
| 1604 | 1640 | T | I | | Pj-102-148 | |
| 1634 | 1670 | A | T | | Pj-1279 | |
| 1638 | 1674 | G | V | | Pj-1344, Pj-1490 | |
| 1650 | 1686 | T | I | | Pj-1364, Pj-1484, Pj-1234 | |
| 1658 | 1694 | K | E | | Pj-1364, Pj-1484, Pj-1234 | |

[1,2] observed amino acid at respective position in any of the sequenced genes of the respective *S. pneumoniae* strains.
—, amino acid deletion.
Strain Pj-1298 shows an insertion of 36 amino acids (GVRSEAATTIYLPKVSRSASAQGTTQELKVVAVGKN) after position 788 relative to the Reference strain TIGR4_Tettelin strain.

Sequence Analyses of SP0609

Sequences were obtained from 54 pneumococcal strains. The level of amino acid sequence identity ranged from 90.3% to 100% as compared to the sequence of SP0609 from *S. pneumoniae* TIGR4_Tettelin. Table 5 lists all 42 amino acid positions which showed a distinct amino acid as compared to SP0609 from the Reference strain *S. pneumoniae* TIGR4_Tettelin.

TABLE 5

Gene conservation of SP0609.

| Reference position | Alignment position | Amino acid in Reference | AA change[1] | AA change[2] | Strains with respective change[1] | Strains with respective change[2] |
|---|---|---|---|---|---|---|
| n.p. | 1 | n.p. | M | | All 54 strains | |
| n.p. | 2 | n.p. | K | | All 54 strains | |
| n.p. | 3 | n.p. | K | | All 54 strains | |
| n.p. | 4 | n.p. | K | | All 54 strains | |
| n.p. | 5 | n.p. | F | | All 54 strains | |
| n.p. | 6 | n.p. | F | | All 54 strains | |
| n.p. | 7 | n.p. | L | | All 54 strains | |
| n.p. | 8 | n.p. | S | | All 54 strains | |
| n.p. | 9 | n.p. | A | | All 54 strains | |
| n.p. | 10 | n.p. | L | | All 54 strains | |
| 5 | 15 | F | L | | I-33_Andersson | |
| 6 | 16 | G | S | | Pj-1229, Pj-1291_Andersson | |
| 8 | 18 | A | T | V | Pj-1291_Andersson | Pj-102-77, Pj-1230, Pj-1232, Pj-1284, Pj-1369 |
| 16 | 26 | D | N | | Pj-102-77, Pj-1230, Pj-1232, Pj-1284, Pj-1369 | |

TABLE 5-continued

Gene conservation of SP0609.

| Reference position | Alignment position | Amino acid in Reference | AA change[1] | AA change[2] | Strains with respective change[1] | Strains with respective change[2] |
|---|---|---|---|---|---|---|
| 18 | 28 | S | N | | Pj-1279 | |
| 19 | 29 | I | V | | I-33_Andersson, Pj-1291_Andersson | |
| 31 | 41 | G | D | | Pj-1322 | |
| 48 | 58 | T | S | | Pj-1291_Andersson | |
| 59 | 69 | M | I | | Pj-102-93, Pj-102-228 | |
| 60 | 70 | V | I | | Pj-1291_Andersson | |
| 68 | 78 | I | V | | I-33_Andersson, Pj-1291_Andersson | |
| 69 | 79 | R | H | | Pj-102-77, Pj-1230 | |
| 79 | 89 | G | A | | Pj-1250 | |
| 84 | 94 | N | H | | Pj-1322 | |
| 87 | 97 | V | G | | Pj-1236, Pj-1248, Pj-1262, Pj-1330 | |
| 124 | 134 | K | N | | Pj-1291_Andersson | |
| 127 | 137 | K | S | | I-33_Andersson, Pj-1291_Andersson | |
| 133 | 143 | G | S | | Pj-102-94, Pj-102-163, Pj-1237, Pj-1297, Pj-1345 | |
| 141 | 151 | G | S | | Pj-102-148, Pj-1297 | |
| 146 | 156 | R | C | | Pj-102-94, Pj-102-163, Pj-1233, Pj-1237, Pj-1297, Pj-1345 | |
| 156 | 166 | G | D | | Pj-1242 | |
| 158 | 168 | K | T | | Pj-102-93, Pj-102-94, Pj-102-148, Pj-102-163, Pj-102-228, Pj-1232, Pj-1233, Pj-1237, Pj-1284, Pj-1297, Pj-1322, Pj-1345, Pj-1369, PBI-71, Pj-1291_Andersson | |
| 181 | 191 | T | A | | Pj-102-59, Pj-102-77, Pj-102-93, Pj-102-94, Pj-102-98, Pj-102-148, Pj-102-163, Pj-102-228, Pj-102-386, Pj-1344, Pj-1490, Pj-1228, Pj-1230, Pj-1231, Pj-1232, Pj-1233, Pj-1236, Pj-1237, Pj-1241, Pj-1242, Pj-1248, Pj-1250, Pj-1262, Pj-1283, Pj-1284, Pj-1297, Pj-1298, Pj-1300, Pj-1322, Pj-1330, Pj-1345, Pj-1369, Pj-1386, PBI-71, I-33_Andersson, Pj-1291_Andersson | |
| 193 | 203 | T | I | | I-33_Andersson, Pj-1291_Andersson | |
| 194 | 204 | S | N | | Pj-102-59, Pj-102-98, Pj-102-386, Pj-1231, Pj-1241, Pj-1242, Pj-1250, Pj-1283, Pj-1298, Pj-1300, Pj-1386, PBI-71 | |
| 198 | 208 | A | E | V | Pj-102-77, Pj-102-93, Pj-102-94, Pj-102-163, Pj-102-228, Pj-1344, Pj-1490, Pj-1228, Pj-1230, Pj-1232, Pj-1233, Pj-1237, Pj-1284, Pj-1297, Pj-1322, Pj-1345, Pj-1369, Pj-1291_Andersson | I-33_Andersson |
| 220 | 230 | L | F | | Pj-1236, Pj-1248, Pj-1262, Pj-1330 | |
| 222 | 232 | D | N | | Pj-1322 | |
| 224 | 234 | L | F | | Pj-1291_Andersson | |
| 226 | 236 | N | Q | T | Pj-1291_Andersson | Pj-102-93, Pj-102-160, Pj-102-161, Pj-102-228, Pj-1255 |
| 242 | 252 | D | G | | Pj-1322 | |

[1,2]observed amino acid at respective position in any of the sequenced genes of the respective *S. pneumoniae* strains.
n.p., corresponding amino acids not present.

Sequence Analyses of SP0749

Sequences were obtained from 53 pneumococcal strains. The level of amino acid sequence identity ranged from 99% to 100% as compared to the sequence of SP0749 from *S. pneumoniae* TIGR4_Tettelin. Table 6 lists all 13 amino acid positions which showed a distinct amino acid as compared to SP0749 from the Reference strain *S. pneumoniae* TIGR4_Tettelin.

TABLE 6

Gene conservation of SP0749.

| Reference position | Alignment position | Amino acid in Reference | AA change[1] | Strains with respective change[1] |
|---|---|---|---|---|
| 22 | 22 | G | V | Pj-1344, Pj-1490, Pj-1228 |
| 73 | 73 | A | G | Pj-1231, Pj-1298 |
| 85 | 85 | V | I | Pj-102-62, Pj-102-70, Pj-102-77, Pj-102-93, Pj-102-161, Pj-1230, Pj-1233, Pj-1279 |
| 123 | 123 | A | V | Pj-1279 |
| 126 | 126 | A | S | Pj-102-62, Pj-102-70 |
| 224 | 224 | K | N | Pj-1344, Pj-1490, Pj-1228 |
| 228 | 228 | K | R | Pj-102-93, Pj-102-161, Pj-1279 |

TABLE 6-continued

Gene conservation of SP0749.

| Reference position | Alignment position | Amino acid in Reference | AA change[1] | Strains with respective change[1] |
|---|---|---|---|---|
| 252 | 252 | M | K | Pj-1279 |
| 275 | 275 | A | V | Pj-102-62, Pj-102-70 |
| 341 | 343 | N | D | Pj-102-62, Pj-102-70, Pj-102-77, Pj-102-98, Pj-102-148, Pj-102-160, Pj-102-386, Pj-1344, Pj-1490, Pj-1228, Pj-1230, Pj-1232, Pj-1233, Pj-1236, Pj-1250, Pj-1255, Pj-1262, Pj-1284, Pj-1291, Pj-1297, Pj-1300, Pj-1330, Pj-1345, Pj-1347, Pj-1369, PBI-71 |
| 342 | 344 | N | S | Pj-1300 |
| 362 | 364 | H | Y | Pj-1283 |
| 386 | 388 | P | S | Pj-1322 |

[1]observed amino acid at respective position in any of the sequenced genes of the respective *S. pneumoniae* strains. Strain Pj-1229 shows an insertion of 2 amino acids (AK) after position 294 relative to the Reference strain TIGR4_Tettelin.

Sequence Analyses of SP2027

Sequences were obtained from 53 pneumococcal strains. The level of amino acid sequence identity ranged from 97.8% to 100% as compared to the sequence of SP2027 from *S. pneumoniae* TIGR4_Tettelin. Table 7 lists all 7 amino acid positions which showed a distinct amino acid as compared to SP2027 from the Reference strain *S. pneumoniae* TIGR4_Tettelin.

TABLE 7

Gene conservation of SP2027.

| Reference position | Alignment position | Amino acid in Reference | AA change[1] | Strains with respective change[1] |
|---|---|---|---|---|
| 1 | 1 | V | M | I-33_Andersson |
| 4 | 4 | L | P | Pj-1231, Pj-1298, Pj-1322 |
| 5 | 5 | T | K | I-33_Andersson |
| 18 | 18 | P | Q | I-33_Andersson |
| 22 | 22 | L | I | Pj-102-161, Pj-1364, Pj-1484, Pj-1234, Pj-1255, Pj-1284, Pj-1300 |
| 24 | 24 | A | T | Pj-1364, Pj-1484, Pj-1234, Pj-1284 |
| 86 | 86 | A | S | Pj-102-148 |

[1]observed amino acid at respective position in any of the sequenced genes of the respective *S. pneumoniae* strains.

Sequence Analyses of SP2194

Sequences were obtained from 18 pneumococcal strains. The level of amino acid sequence identity ranged from 99.3% to 100% as compared to the sequence of SP2194 from *S. pneumoniae* TIGR4_Tettelin. Table 8 lists all 17 amino acid positions which showed a distinct amino acid as compared to SP2194 from the Reference strain *S. pneumoniae* TIGR4_Tettelin.

TABLE 8

Gene conservation of SP2194.

| Reference position | Alignment position | Amino acid in Reference | AA change[1] | Strains with respective change[1] |
|---|---|---|---|---|
| 4 | 4 | S | L | Pj-1234 |
| 54 | 54 | M | L | Pj-1237 |
| 86 | 86 | V | I | Pj-1237 |
| 91 | 91 | A | S | Pj-1237 |
| 109 | 109 | L | F | Pj-1250, Pj-1284 |
| 116 | 116 | S | G | Pj-102-228, Pj-1364, Pj-1230, Pj-1231, Pj-1234, Pj-1236, Pj-1237, Pj-1241, Pj-1250, Pj-1262, Pj-1283, Pj-1284, Pj-1291 |
| 257 | 257 | P | S | Pj-1241 |
| 262 | 262 | K | N | Pj-1250 |
| 433 | 433 | A | S | Pj-102-228, Pj-1230, Pj-1236, Pj-1262 |
| 435 | 435 | H | Y | Pj-102-93, Pj-1250 |
| 565 | 565 | V | A | Pj-102-228 |
| 714 | 714 | V | A | Pj-1232 |

TABLE 8-continued

Gene conservation of SP2194.

| Reference position | Alignment position | Amino acid in Reference | AA change[1] | Strains with respective change[1] |
|---|---|---|---|---|
| 739 | 739 | T | A | Pj-102-70, Pj-102-93, Pj-102-161, Pj-102-228, Pj-1364, Pj-1484, Pj-1230, Pj-1231, Pj-1232, Pj-1234, Pj-1236, Pj-1237, Pj-1241, Pj-1250, Pj-1262, Pj-1283, Pj-1284, Pj-1291 |
| 742 | 742 | G | C | Pj-1237 |
| 759 | 759 | G | V | Pj-102-228 |
| 762 | 762 | P | L | Pj-1230 |
| 794 | 794 | S | N | Pj-102-161, Pj-1364, Pj-1484, Pj-1232, Pj-1234 |

[1]observed amino acid at respective position in any of the sequenced genes of the respective *S. pneumoniae* strains.

TABLE 9

Sequence conservation of *S. pneumoniae* genes in various strains.

| Strain name | SP0498 | SP0609 | SP0749 | SP2027 | SP2194 |
|---|---|---|---|---|---|
| Pj-102-59 | Seq ID 45 | Seq ID 94 | IDENT. | IDENT. | n.d. |
| Pj-102-62 | Seq ID 46 | IDENT. | Seq ID 137 | IDENT. | n.d. |
| Pj-102-70 | Seq ID 47 | IDENT. | Seq ID 138 | IDENT. | Seq ID 187 |
| Pj-102-77 | Seq ID 48 | Seq ID 95 | Seq ID 139 | IDENT. | n.d. |
| Pj-102-93 | Seq ID 49 | Seq ID 96 | Seq ID 140 | IDENT. | Seq ID 188 |
| Pj-102-94 | Seq ID 50 | Seq ID 97 | IDENT. | IDENT. | n.d. |
| Pj-102-98 | Seq ID 51 | Seq ID 98 | Seq ID 141 | IDENT. | n.d. |
| Pj-102-113 | IDENT. | IDENT. | IDENT. | IDENT. | n.d. |
| Pj-102-148 | Seq ID 52 | Seq ID 99 | Seq ID 142 | Seq ID 173 | n.d. |
| Pj-102-160 | Seq ID 53 | Seq ID 100 | Seq ID 143 | IDENT. | n.d. |
| Pj-102-161 | Seq ID 54 | Seq ID 101 | Seq ID 144 | Seq ID 174 | Seq ID 189 |
| Pj-102-163 | Seq ID 55 | Seq ID 102 | IDENT. | IDENT. | n.d. |
| Pj-102-174 | Seq ID 56 | IDENT. | IDENT. | IDENT. | n.d. |
| Pj-102-228 | Seq ID 57 | Seq ID 103 | IDENT. | IDENT. | Seq ID 190 |
| Pj-102-386 | Seq ID 58 | Seq ID 104 | Seq ID 145 | IDENT. | n.d. |
| Pj-102-468 | Seq ID 59 | IDENT. | IDENT. | IDENT. | n.d. |
| Pj-1344 | Seq ID 60 | Seq ID 105 | Seq ID 146 | IDENT. | n.d. |
| Pj-1364 | Seq ID 61 | IDENT. | IDENT. | Seq ID 175 | Seq ID 191 |
| Pj-1484 | Seq ID 62 | IDENT. | IDENT. | Seq ID 176 | Seq ID 192 |
| Pj-1490 | Seq ID 63 | Seq ID 106 | Seq ID 147 | IDENT. | n.d. |
| Pj-1228 | Seq ID 64 | Seq ID 107 | Seq ID 148 | IDENT. | n.d. |
| Pj-1229 | Seq ID 65 | Seq ID 108 | IDENT. | IDENT. | n.d. |
| Pj-1230 | Seq ID 66 | Seq ID 109 | Seq ID 149 | IDENT. | Seq ID 193 |
| Pj-1231 | Seq ID 67 | Seq ID 110 | Seq ID 150 | Seq ID 177 | Seq ID 194 |
| Pj-1232 | Seq ID 68 | Seq ID 111 | Seq ID 151 | IDENT. | Seq ID 195 |
| Pj-1233 | Seq ID 69 | Seq ID 112 | Seq ID 152 | IDENT. | n.d. |
| Pj-1234 | Seq ID 70 | IDENT. | IDENT. | Seq ID 178 | Seq ID 196 |
| Pj-1236 | Seq ID 71 | Seq ID 113 | Seq ID 153 | IDENT. | Seq ID 197 |
| Pj-1237 | Seq ID 72 | Seq ID 114 | IDENT. | IDENT. | Seq ID 198 |
| Pj-1241 | Seq ID 73 | Seq ID 115 | IDENT. | IDENT. | Seq ID 199 |
| Pj-1242 | Seq ID 74 | Seq ID 116 | IDENT. | IDENT. | n.d. |
| Pj-1244 | IDENT. | IDENT. | IDENT. | IDENT. | n.d. |
| Pj-1248 | Seq ID 75 | Seq ID 117 | IDENT. | IDENT. | n.d. |
| Pj-1250 | Seq ID 76 | Seq ID 118 | Seq ID 154 | IDENT. | Seq ID 200 |
| Pj-1255 | Seq ID 77 | Seq ID 119 | Seq ID 155 | Seq ID 179 | n.d. |
| Pj-1262 | Seq ID 78 | Seq ID 120 | Seq ID 156 | IDENT. | Seq ID 201 |
| Pj-1279 | Seq ID 79 | Seq ID 121 | Seq ID 157 | IDENT. | n.d. |
| Pj-1283 | Seq ID 80 | Seq ID 122 | Seq ID 158 | IDENT. | Seq ID 202 |
| Pj-1284 | Seq ID 81 | Seq ID 123 | Seq ID 159 | Seq ID 180 | Seq ID 203 |
| Pj-1291 | Seq ID 82 | IDENT. | Seq ID 160 | IDENT. | Seq ID 204 |
| Pj-1297 | Seq ID 83 | Seq ID 124 | Seq ID 161 | IDENT. | n.d. |
| Pj-1298 | Seq ID 84 | Seq ID 125 | Seq ID 162 | Seq ID 181 | n.d. |
| Pj-1300 | Seq ID 85 | Seq ID 126 | Seq ID 163 | Seq ID 182 | n.d. |
| Pj-1322 | Seq ID 86 | Seq ID 127 | Seq ID 164 | Seq ID 183 | n.d. |
| Pj-1330 | Seq ID 87 | Seq ID 128 | Seq ID 165 | IDENT. | n.d. |
| Pj-1345 | n.d. | Seq ID 129 | Seq ID 166 | IDENT. | n.d. |
| Pj-1347 | Seq ID 88 | IDENT. | Seq ID 167 | IDENT. | n.d. |
| Pj-1369 | Seq ID 89 | Seq ID 130 | Seq ID 168 | IDENT. | n.d. |
| Pj-1386 | Seq ID 90 | Seq ID 131 | IDENT. | IDENT. | n.d. |
| PBI-71 | Seq ID 91 | Seq ID 132 | Seq ID 169 | IDENT. | n.d. |
| I-33_Andersson | n.d. | Seq ID 133 | n.d. | Seq ID 184 | n.d. |
| Pj-1291_Andersson | n.d. | Seq ID 134 | Seq ID 170 | n.d. | n.d. |
| TIGR4_DB | Seq ID 92 | Seq ID 135 | Seq ID 171 | Seq ID 185 | n.d. |
| TIGR4_IC | Seq ID 93 | Seq ID 136 | Seq ID 172 | Seq ID 186 | Seq ID 205 |

Example 2

Pneumococcal Antigens and Combinations Inducing Protective Immune Responses Against *S. pneumoniae* in Lethal Sepsis and Pneumonia Models

Example 2.1

Evaluation of Five Novel Pneumococcal Antigens for Protectivity in Lethal Sepsis and Pneumonia Models Experimental Procedures
Expression and Purification of Recombinant Pneumococcal Proteins: as Described in Example 1.
Animal Protection Studies Animals: C3H/HeN and CD-1 female mice were used.

Active immunization: 50 µg of recombinant proteins were injected subcutaneously, adjuvanted with Complete Freund adjuvant (CFA) or aluminum hydroxide (ALUM). Animals were boosted twice with the same amount of protein and adjuvant, (except for CFA where Incomplete Freund adjuvant (IFA) was used) at days 14 and 28. The published protective antigen PspA (SP0117), lysate or Prevnar was used as a positive control, while mice immunized with adjuvant only served as negative controls. Antibody titres were measured at day 35 by ELISA using the respective recombinant proteins.

Bacterial challenge: A frozen glycerol stock of *S. pneumoniae* serotype 6B strain Pj-1259, serotype 19F strain EF3030 or serotype 3 strain WU2 was prepared and used for all experiments. In order to determine the viable cell numbers present in the bacterial inoculum, cfus were determined via plating on blood agar plates. $1 \times 10^4$-$5 \times 10^7$ cfu were applied intraperitoneally or intranasally as challenge into individual mice. For intranasal applications, mice were anesthetized before the treatment. Protection by immunization was measured for both, a sepsis and a pneumonia model. In the i.p. sepsis model (serotype 6B strain Pj-1259), survival rates were followed for 2 weeks post-challenge and survival was expressed in percentage of total number of animals (10 mice/group). For the pneumonia model (serotype 19F strain EF3030, serotype 3 strain WU2), lungs were removed at day 3 post challenge under sterile conditions, homogenized and cultures of lung homogenates were quantitatively plated on blood agar plates. Cfus per organ were determined for each individual mouse (5-10 mice/group).

Results

In the present invention single antigens and combinations of different pneumococcal antigens were identified showing a high level of protection in a mouse sepsis/lethality as well as in a pneumonia model. For initial experiments, additional 19 antigens, selected by the original AIP screens and in vitro validations, were chosen to be evaluated in a sepsis model for their protectivity. Two experiments were performed, one where the proteins were adjuvanted with ALUM and in the other experiment the proteins were mixed with CFA/IFA to induce a maximal antibody titer. Five out of the 19 proteins tested in combination with ALUM showed at least partial protection in the sepsis model, namely SP0498, SP0609, SP0749, SP2027 and SP2194 (FIG. 1A). In the repetition experiment with CFA/IFA out of the 19 tested candidates three candidates which were also protective in the first experiment showed again some protection, SP0749, SP2027 and SP2194 (FIG. 1B).

The five single proteins were either combined with SP1732-3+SP2216-1 or with SP1732-3+SP1650 (PsaA). All five proteins which were included in the combination with SP1732-3 and SP2216-1 (FIG. 2) showed an increased protection level compared with the negative control. The same could be observed when the five candidate antigens were combined with SP1732-3 and PsaA (FIG. 3).

In parallel to the testing of antigen protectivity in the sepsis model, experiments were also performed in the pneumonia models. This could be particularly relevant for an elderly vaccine where pneumonia is the major cause of disease.

Immunization and challenge experiments using the WU2 pneumonia model showed that from the single proteins only SP0609, SP2027 (1-2 log reduction) had an effect on colonization at day 3 post challenge (FIG. 4A). The most effective was crude lysate from the homologous strain (4 logs reduction). The same proteins were also tested in the EF3030 pneumonia model. As already seen in earlier experiments, the variability within the experiment was much broader than for the WU2 model. Significant reduction of about 4 logs could be seen for SP2027 and SP2194. A minor reduction was seen for SP0609, PspA and Prevnar (between 1 and 2 logs reduction; FIG. 4B).

When testing the new candidates in combination with SP1732-3 and SP2216-1 in the WU2 pneumonia model (FIG. 5A), combinations including SP0749, SP2027 or SP2194 reduced the bacterial count in the lung by about two logs. A minor reduction could be additionally seen in combination with SP0498 and SP0609 (~1 log reduction). In the EF3030 model (FIG. 5B) the best reduction (~4 logs) was seen with the combination including SP2027 or with Prevnar. For the combination with SP2027, mice either had a high bacterial count in the lung or had it completely cleared by day 3. Combinations including SP0609, SP0749 and SP2194 showed a medium reduction in lung colonization at day 3 post challenge of ~2 logs.

Example 2.2

Evaluation of Three Additional Pneumococcal Antigens for Protectivity in Lethal Sepsis and Pneumonia Models Experimental Procedures
Expression and Purification of Recombinant Pneumococcal Proteins: as Described in Example 1.
Animal Protection Studies Animals: C3H/HeN, CBA/N and NMRI female mice were used.

Active immunization: 50 µg of recombinant proteins were injected subcutaneously, adjuvanted with Complete Freund's adjuvant (CFA), aluminum hydroxide or IC31®. Animals were boosted twice with the same amount of protein and adjuvant, (except for CFA where Incomplete Freund's adjuvant (IFA) was used) at days 14 and 28. The published protective antigen PspA (SP0117) was used as a positive control, while mice immunized with adjuvant only served as negative controls. Antibody titres were measured at day 35 by ELISA using the respective recombinant proteins, in order to confirm that the immunization had induced a proper immune response.

Bacterial challenge: A frozen glycerol stock of *S. pneumoniae* serotype 6B strain Pj-1259, strain EF3030 or strain TIGR4_DB was prepared and used for all experiments including these strains. For other *S. pneumoniae* strains (e.g. 6301) freshly grown bacteria were used. In order to determine the viable cell numbers present in the bacterial inoculum, cfus were determined via plating on blood agar plates. $10^2$-$10^8$ cfu were applied intraperitoneally, intravenously or intranasally as challenge into individual mice. For intranasal applications, mice were anesthetized before the treatment. Protection by immunization was measured for both, a sepsis and pneumonia model. In the sepsis model, survival rates were followed for approximately 2 weeks post-challenge and survival was expressed in percentage of total number of animals (10 mice/group). For the pneumonia model, lungs were removed at day 3 post challenge under sterile conditions, homogenized and cultures of lung homogenates were quantitatively plated on blood agar plates. Cfus per organ were determined for each individual mouse (5-10 mice/group).

Results

Combinations of different pneumococcal antigens were identified showing a larger level of protection in a mouse sepsis/lethality model than the individual proteins alone (FIG. 6). The best levels of protection were achieved by immunization with a combination of three recombinant proteins SP2216-1, SP1732-3 and PsaA, while lower levels of protection were observed with combinations of only two proteins (SP2216-1+SP1732-3 superior to SP2216-1+PsaA superior to SP1732-3+PsaA). PsaA alone did not show a significant level of protection, but in combination with the other two proteins increased the protection level significantly. No negative influence on the protection level could be observed for any of the proteins tested. The increase in protection levels was independent of the adjuvant used, since no difference in protection was seen by using either Aluminum hydroxide or IC31® adjuvant (Intercell AG, Vienna, Austria).

SP2216-1 and SP1732-3 were not only been shown to be protective against *S. pneumoniae* 6B (FIG. 6), but it could be also demonstrated that they provided protection against different serotypes of *S. pneumoniae*. Protection could be shown against sepsis for *S. pneumoniae* strain 6301 (serotype 1) after intranasal application, which represents the more physiological way of challenge in contrast to the intraperitoneal route. SP2216-1 demonstrated a significant level of protection against sepsis in this model, which was higher than the protection capacity of PspA, the positive control protein. SP1732-3 showed a significant level of protection comparable to PspA, and well above the negative control (FIG. 7).

CBA/N mice have a spontaneous mutation in the xid gene and therefore lack the ability to produce antibodies to polysaccharides and lack serum antibodies to the phosphocholine determinant of pneumococcal teichoic acid. Immunization with SP2216-1 and SP1732-3 provided protection against challenge with the *S. pneumoniae* TIGR4_DB strain (serotype 4) in CBA/N mice. The protective effect was therefore clearly due to antibodies directed against the immunized proteins, but not against the bacterial polysaccharide. Although it is well known that the TIGR4_DB strain is a highly virulent strain of *S. pneumoniae*, mice were partially protected after vaccination with both proteins. The protection levels were well above the negative control, although not as high as those for PspA (FIG. 8).

Significant protection was also observed in additional sepsis models with a variety of serotypes of *S. pneumoniae* after immunization with both proteins, SP2216-1 and SP1732-3 (data not shown).

Beside sepsis, pneumonia is a major cause of pneumococcal death in patients. Therefore, it is relevant to show that protection or reduction of bacterial colonization can be induced by the vaccine candidates SP1732-3 and SP2216-1. Here we demonstrate the protective effect of a pneumococcal antigen against pneumonia. Mice immunized with SP2216-1 showed a reduced level of colonization when lung homogenates were tested for colonization 6 days after challenge with *S. pneumoniae* strain EF3030 (serotype 19F) (FIG. 9). SP2216-1 vaccinated animals clearly promoted a reduced bacterial load (2 to 3 log reduced) in the lung.

Example 2.3

Further Evaluation of the Three Additional Pneumococcal Antigens for Protectivity Experimental Procedures Expression and Purification of Recombinant Pneumococcal Proteins: as Described in Example 1.

Animal Protection Studies

Animals: C3H/HeN, CD-1 and NMRI female mice were used.

Active immunization: 50 µg of recombinant proteins were injected subcutaneously or intramuscularly, adjuvanted with aluminum hydroxide (ALUM). Animals were boosted twice with the same amount of protein and adjuvant at days 14 and 28. The published protective antigen PspA (SP0117), Prevnar or the respective lysate was used as a positive control, while mice immunized with adjuvant only served as negative controls. Antibody titres were measured at day 35 by ELISA using the respective recombinant proteins.

Bacterial challenge: A frozen glycerol stock of *S. pneumoniae* serotype 6B strain Pj-1259, strain WU2 (serotype 3) or strain EF3030 (serotype 19F) was prepared and used for all experiments including these strains. For other *S. pneumoniae* serotypes (e.g. *S. pneumoniae* 6301—serotype 1) freshly grown bacteria were used for all experiments. In order to determine the viable cell numbers present in the bacterial inoculum, cfus were determined via plating on blood agar plates. $10^4$-$10^8$ cfu were applied intraperitoneally or intranasally, as challenge into individual mice. For intranasal applications, mice were anesthetized before the treatment. Protection by immunization was measured for both, a sepsis and pneumonia model. In the sepsis model, survival rates were followed for 2 weeks post-challenge and survival was expressed in percentage of total number of animals (10 mice/group). For the pneumonia model, lungs were removed at day 3 post challenge under sterile conditions, homogenized and cultures of lung homogenates were quantitatively plated on blood agar plates. Cfus per organ were determined for each individual mouse (10 mice/group).

Results

Combinations of different pneumococcal antigens were identified showing a similar or larger level of protection in mouse pneumonia models than the individual proteins alone (FIG. 10). Upon immunization with ALUM, the highest reduction in colonization with WU2 (serotype 3) was achieved, besides the lysate control, by immunization with a combination of two or three recombinant proteins, SP2216-1, SP1732-3 (and SP1650 (PsaA)), while lower levels of protection were observed with the single proteins as well as with the second positive control, PspA (FIG. 10A). SP1650 (PsaA) alone did not show a significant level of protection, but had no negative influence on the protection using combinations including SP2216-1 and SP1732-3.

Immunization and challenge experiments using the EF3030 pneumonia model (serotype 19F) in combination with ALUM adjuvant showed that particularly SP1732-3, SP2216-1+SP1732-3, SP2216-1+SP1732-3+SP1650 as well as Prevnar lowered lung colonization by day 3 substantially (by 3 to 5 logs) (FIG. 10B). PspA had also a beneficial effect on the reduction of colonization (1 to 4 logs). SP1650 did not reduce lung colonization at all. In combination with SP1732-3 and SP2216-1, SP1650 in general did not change the outcome substantially.

So far, all experiments have been performed using the subcutaneous immunization route. To define whether that is the most efficient route in mice, experiments were performed to compare the subcutaneous versus the intramuscular route in the 6B sepsis/lethality model. Combinations including all three proteins (SP2216-1, SP1732-3 and SP1650) were compared to the combination of SP2216-1 and SP1732-3. As seen in FIG. 11, no significant difference for the combination of all three proteins could be observed. For the combination with two proteins, the subcutaneous route showed slightly better protection.

Combinations of the proteins SP2216-1, SP1732-3 and SP1650 (PsaA) were not only shown to be protective against *S. pneumoniae* 6B, WU2 and EF3030 (FIGS. 10, 11), but it could be also demonstrated that they provided protection against a further serotype of *S. pneumoniae*. Protection could be obtained against sepsis for *S. pneumoniae* strain 6301 (serotype 1) after intranasal application, which represents the more physiological way of challenge in contrast to the intraperitoneal route. The best protection was seen for the combination including all three proteins or the combination of only SP1732-3 and SP2216-1 (FIG. 12).

SEQUENCE LISTING (333 sequences)

SEQ ID NO: 1 - protein, 778 aa, Artificial Sequence
  Construct 1: SP0498 aa
GAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFTEEKTELDRLTGEVQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPTSDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDK

SEQ ID NO: 2 - protein, 254 aa, Artificial Sequence
  Construct 2: SP0609 aa
LISLFGLAAAKPVQADTSIADIQKRGELVVGVKQDVPNFGYKDPKTGTYPGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDTFSVDRSILSGYTSKRTALLDDSFKPSDYGIVTKKSNTELNDYLDNLVTKWSKDGSLQKLYDRYKLKPSSHTAD

SEQ ID NO: 3 - protein, 359 aa, Artificial Sequence
  Construct 3: SP0749 aa
AVNTAGNSVEEKTIKIGFNFEESGSLAAYGTAEQKGAQLAVDEINAAGGIDGKQIEVVDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADHNTVKTAYMMTMNNGKVEAAEVVKP

SEQ ID NO: 4 - protein, 135 aa, Artificial Sequence
  Construct 4: SP2027 aa
ENLTNFYEKYRVYLTRPRLELLAVVTIVFCAVLVFFLNIPGKGVLKLDNGTIVYDGSLVRGKMNGQGTITFQNGDQYTGGFNNGAFNGKGTFQSKEGWTYEGDFVNGQAEGKGKLTTEQEVVYEGTFKQGVFQQK

SEQ ID NO: 5 - protein, 809 aa, Artificial Sequence
  Construct 5: SP2194 aa
NYSKALNGCIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDSNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLTEKGIDLKLQASALKLLANQGYDPEMGARPLRRTLQTEVEDKLAELLLKGDLVAGSTLKIGVKAGQLKFDIA

SEQ ID NO: 6 - protein, 251 aa, Artificial Sequence
  Construct 6: SP2216-1 aa
ETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRP

SEQ ID NO: 7 - protein, 315 aa, Artificial Sequence
  Construct 7: SP1732-3 aa
YLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 8 - protein, 289 aa, Artificial Sequence
  Construct 8: SP1650 (PsaA) aa
ASGKKDTTSGQKLKVVATNSIIADITKNIAGDKIDLHSIVPIGQDPHEYEPLPEDVKKTSEADLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEEEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 9 - DNA, 2334 bp, Artificial Sequence
  Construct 1: SP0498 nt
ggagctggtggtgagtctgttaacgatggcttgatgaacactaaagactttgacctttattataaagatgcagatggtgagtggaagctagctaaggaagtccgtggtaacaaagcacacgtgacagatatcactcttgataaaccaatcactgctcaagactggcgcttgaatgttgtcacttctgacaatggaactccatggaaggctattcgtatctataactggaaaatgtatgaaaagcttgatactgagagtgtcaatattccgatggccaaggctgcagcccgttctctaggcaataacaaggtacaagttggctttgcagatgtaccggctggagcaactattaccgtttatgataatccaaattctcaaactccgctcgcaaccttgaagagcgaagttggaggagacctagcaagtgcaccattggatttgacaaatcaatctggtcttctttattatcgtacccagttgccaggcaaggaaattagtaatgtcctagcagtttccgttccaaaagatgacagaagaatcaagtcagtcagcctagaaacaggacctaagaaaacaagctacgccgaaggggaggatttggaccttagaggtggtgttcttcgagttcagtatgaaggaggaactgaggacgaactcattcgcctaactcacgcaggtgtatcagtatcaggttttgatacgcatcataagggagaacagaatcttactctccaatatttgggacaaccggtaaatgctaatttgtcagtgactgtcactggccaagacgaagcaagtccgaaaactattttgggaattgaagtaagtcaggaaccgaaaaaagattacctagttggtgatagcttagacttgtctgaaggacgctttgcagtggcttatagcaatgacaccatggaagaacattcctttactgatgagggagttgaaatttctggttacgatgctcaaaagactggtcgtcaaaccttgacgcttcattaccaaggccatgaagttagctttgatgttttggtatctccaaaagcagcattgaacgatgagtacctcaaacaaaaattagcagaagttgaagctgctaagaacaaggtggtctataactttgcttcatcagaagtaaaagaagccttcttgaaagcaattgaagcggccgaacaagtgttgaaagaccatgaaactagcacccaagatcaagtcaatgaccgacttaataaattgacagaagctcataaagctctgaatggtcaagagaaatttacggaagaaaagacagagcttgatcgcttaacaggtgaggttcaagaactcttggctgccaaaccaaaccatccttcaggttctgccctagctccgcttcttgagaaaaacaaggccttggttgaaaaagtagatttgagtccagaagagcttacaacagcgaaacagagtctaaaagatctggttgctttattgaaagaagacaagccagcagtcttttctgatagtaaaacaggtgttgaagtacacttctcaaataaagagaagactgtcatcaagggtttgaaagtagagcgtgttcaagcaagtgctgaagagaagaaatactttgctggagaagatgctcatgtctttgaaatagaaggtttggatgaaaaaggtcaagatgttgatctctcttatgcttctattgtgaaaatcccaattgaaaaagataagaaagttaagaaagtatttttcttacctgaaggcaaagaggcagtagaattggcttttgaacaaacggatagtcatgttatctttacagcacctcactttactcattatgcctttgtttatgaatctgctgaaaaaccacaacctgctaaaccagcaccacaaaacacagtccttccaaaacctacttatcaaccgacttctgatcaacaaaaggctcctaaattggaagttcaagaggaaaaggttgcctttcatcgtcaagagcatgaaaatactgagatgctagttggggaacaacgagtcatcatacagggacgagatggactgttaagacatgtctttgaagttgatgaaaacggtcagcgtcgtcttcgttcaacagaagtcatccaagaagcgattccagaaattgttgaaattggaacaaaagtaaaaacagtaccagcagtagtagctacacaggaaaaaccagctcaaaatacagcagttaaatcagaagaagcaagcaaacaattgccaaatacaggaacagctgatgctaatgaagccctaatagcaggcttagccagccttggtcttgctagtttagccttgaccttgagacggaaaagagaagataaa

SEQ ID NO: 10 - DNA, 762 bp, Artificial Sequence
  Construct 2: SP0609 nt
ttgattagccttttcggccttgctgctgccaaaccagtccaggctgatacaagtatcgcagacattcaaaaaagaggcgaactggttgtcggtgtcaaacaagacgttcccaattttggttacaaagatcccaagaccggtacttatcctggtatcgaaaccgacttggccaagatggtagctgatgaactcaaggtcaagattcgctatgtgccggttacagcacaaacccgcggcccccttctagacaatgaacaggtcgatatggatatcgcgacctttaccatcacggacgaacgcaaaaaactctacaactttaccagtccctactacacagacgcttctggatttttggtcaataaatctgccaaaatcaaaaagattgaggacctaaacggcaaaaccatcggagtcgcccaaggttctatcacccaacgcctgattactgaactgggtaaaaagaaaggtctgaagtttaaattcgtcgaacttggttcctacccagaattgattacttccctgcacgctcatcgtatcgataccttttccgttgaccgctctattctatctggctacactagtaaacggacagcactactagatgatagtttcaagccatctgactacggtattgttaccaagaaatcaaatacagagctcaacgactatcttgataacttggttactaaatggagcaaggatggtagtttgcagaaactttatgaccgttacaagctcaaaccatctagccatactgcagat

SEQ ID NO: 11 - DNA, 1077 bp, Artificial Sequence
  Construct 3: SP0749 nt
gcagtcaacactgctggtaactcagtagaggaaaagacaattaaaatcgggtttaactttgaagaatcaggttctttagctgcatacggaacagctgaacaaaaaggtgcccaattggctgttgatgaaatcaatgccgcaggtggtatcgatggaaaacaaatcgaagtagtcgataaagataataagtctgaaacagctgaggctgcttcagttacaactaaccttgtaacccaatctaaagtatcagcagtcgtaggacctgcgacatctggtgcgactgcagctgcggtagcgaacgctacaaaagcaggtgttccattgatctcaccaagtgcgactcaagatggattgactaaaggtcaagattacctctttattggaactttccaagatagcttccaaggaaaaattatctcaaactatgtttctgaaaaattaaatgctaagaaagttgttctttacactgacaatgccagtgactatgctaaagggattgcaaaatctttccgcgagtcatacaagggtgaaatcgttgcagatgaaactttcgtagcaggtgacacagacttccaagcagcccttacaaaaatgaaagggaaagactttgatgctatcgttgttcctggttactataatgaggctggtaaaattgtaaaccaagcgcgtggcatgggaattgacaaaccaatcgttggtggtgatggattcaacggtgaggagtttgtacaacaagcaactgctgaaaaagcatcaaacatctactttatctcaggcttctcaactactgtagaagtttcagctaaagctaaagccttccttgacgcttaccgtgctaagtacaatgaagagccttcaacatttgcagccttggcttatgattcagttcaccttgtagcaaacgcagcaaaaggtgctaaaaattcaggtgaaatcaagaataaccttgctaaaacaaaagattttgaaggtgtaactggtcaaacaagcttcgatgcagaccacaacacagtcaaaactgcttacatgatgaccatgaacaatggtaaagttgaagcagcagaagttgtaaaacca

SEQ ID NO: 12 - DNA, 405 bp, Artificial Sequence
  Construct 4: SP2027 nt
gaaaatcttacgaatttttacgaaaagtatcgtgtctatctgactcgtccacgtttagagcttttggcagtagttaccattgttttctgtgctgtactcgtcttttttctaaatattccaggaaaaggtgtcttaaaactcgataatggaacgattgtttatgatggcagtcttgtccgcggtaaaatgaatggccaaggtaccattaccttccaaaatggagaccaatatacaggtggcttcaacaatggagccttcaacggaaaaggtacctttcaatctaaagaaggctggacctacgaaggtgattttgtaaatggtcaggctgaaggaaaagggaaactaacaacagaacaagaagtcgtttatgaaggaacttttaaacaaggcgtttttcaacaaaaa

SEQ ID NO: 13 - DNA, 2427 bp, Artificial Sequence
  Construct 5: SP2194 nt
aactattcaaaagcattgaatggatgtatcgaaagtgcctacatggttgctggacattttggagctcgttatctagagtcgtggcacttgttgattgccatgtctaatcacagttatagtgtagcaggggcaactttaaatgattatccgtatgagatggaccgtttagaagaggtggctttggaactgactgaaacggactatagccaggatgaaacctttacggaattgccgttctcccgtcgtttgcaggttctttttgatgaagcagagtatgtagcgtcagtggtccatgctaaggtactagggacagagcacgtcctctatgcgattttgcatgatagcaatgccttggcgactcgtatcttggagagggctggtttttcttatgaagacaagaaagatcaggtcaagattgctgctcttcgtcgaaatttagaagaacgggcaggctggactcgtgaagatctcaaggctttacgccaacgccatcgtacagtagctgacaagcaaaattctatggccaatatgatgggcatgccgcagactcctagtggtggtctcgaggattatacgcatgatttgacagagcaagcgcgttctggcaagttagaaccagtcatcggtcgggacaaggaaatctcacgtatgattcaaatcttgagccggaagactaagaacaaccctgtcttggttggggatgctggtgtcgggaaaacagctctggcgcttggtcttgcccagcgtattgctagtggtgacgtgcctgcggaaatggctaagatgcgcgtgttagaacttgatttgatgaatgtcgttgcagggacacgcttccgtggtgactttgaagaacgcatgaataatatcatcaaggatattgaagaagatggccaagtcatcctctttatcgatgaactccacaccatcatgggttctggtagcgggattgattcgactctggatgcggccaatatcttgaaaccagccttggcgcgtggaactttgagaacggttggtgccactactcaggaagaatatcaaaaacatatcgaaaaagatgcggcactttctcgtcgtttcgctaaagtgacgattgaagaaccaagtgtggcagatagtatgactattttacaaggtttgaaggcgacttatgagaaacatcaccgtgtacaaatcacagatgaagcggttgaaacagcggttaagatggctcatcgttatttaaccagtcgtcacttgccagactctgctatcgatctcttggatgaggcggcagcaacagtgcaaaataaggcaaagcatgtaaaagcagacgattcagatttgagtccagctgacaaggccctgatggatggcaagtggaaacaggcagcccagctaatcgcaaaagaagaggaagtacctgtctacaaagacttggtgacagagtctgatattttgaccaccttgagtcgcttgtcaggaatcccagttcaaaaactgactcaaacggatgctaagaagtatttaaatcttgaagcagaactccataaacgggttatcggtcaagatcaagctgtttcaagcattagccgtgccattcgccgcaaccagtcagggattcgcagtcataagcgtccgattggttcctttatgttcctagggcctacaggtgtcgggaaaactgaattagccaaggctctggcagaagttctttttgacgacgaatcagcccttatccgctttgatatgagtgagtatatggagaaatttgcagctagtcgtctcaacggagctcctccaggctatgtaggatatgaagaaggtggggagttgacagagaaggttcgcaataaaccctattccgttctcctctttgatgaggtagagaaggcccacccagatatctttaatgttctcttgcaggttctggatgacggtgtcttgacagatagcaagggacgcaaggtcgatttttcaaataccattatcattatgacatcgaatctaggtgcgactgcccttcgtgatgataagactgttggttttggggctaaggatattcgttttgaccaggaaaatatggaaaaacgcatgtttgaagaactgaaaaaagcttatagaccggaattcatcaaccgtattgatgagaaggtggtcttccatagcctatctagtgatcatatgcaggaagtggtgaagattatggtcaagcctttagtggcaagtttgactgaaaaaggcattgacttgaaattacaagcttcagctctgaaattgttagcaaatcaaggatatgacccagagatgggagctcgcccacttcgcagaaccctgcaaacagaagtggaggacaagttggcagaacttcttctcaagggagatttagtggcaggcagcacacttaagattggtgtcaaagcaggccagttaaaatttgatattgca

SEQ ID NO: 14 - DNA, 753 bp, Artificial Sequence
  Construct 6: SP2216-1 nt
gaaacgactgatgacaaaattgctgctcaagataataaaattagtaacttaacagcacaacaacaagaagcccaaaaacaagttgaccaaattcaggagcaagtatcagctattcaagctgagcagtctaacttgcaagctgaaaatgatagattacaagcagaatctaagaaactcgagggtgagattacagaactttctaaaaacattgtttctcgtaaccaatcgttggaaaaacaagctcgtagtgctcaaacaaatggagccgtaactagctatatcaataccattgtaaactcaaaatcaattacagaagctatttcacgtgttgctgcaatgagtgaaatcgtatctgcaaacaacaaaatgttagaacaacaaaaggcagataaaaaagctatttctgaaaaacaagtagcaaataatgatgctatcaatactgtaattgctaatcaacaaaaattggctgatgatgctcaagcattgactacgaaacaggcagaactaaaagctgctgaattaagtcttgctgctgagaaagcgacagctgaaggggaaaaagcaagtctattagagcaaaaagcagcagctgaggcagaggctcgtgcagctgcggtagcagaagcagcttataaagaaaaacgagctagccaacaacaatcagtacttgcttcagcaaacactaacttaacagctcaagtgcaagcagtatctgaatctgcagcagcacctgtccgtgcaaaagttcgtcca

SEQ ID NO: 15 - DNA, 945 bp, Artificial Sequence
  Construct 7: SP1732-3 nt
tacctgattttgttggccagccttgtattggtggcagcttctcttatttggatactatccagaactcctgcaaccattgccattccagatgtggcaggtcagacagttgcagaggccaaggcaacgctcaaaaaagccaattttgagattggtgaggagaagacagaggctagtgaaaaggtggaagaagggcggattatccgtacagatcctggcgctggaactggtcgaaaagaaggaacgaaaatcaatttggttgtctcatcaggcaaacaatccttccaaattagtaattatgtcggccggaaatcttctgatgttatcgcggaattaaaagagaaaaaagttccagataatttgattaaaattgaggaagaagagtcgaatgagagtgaggctggaacggtcctgaagcaaagtctaccagaaggtacgacctatgacttgagcaaggcaactcaaattgttttgacagtagctaaaaaagctacgacgattcaattagggaactatattggacggaactctacagaagtaatctcagaactcaagcagaagaaggttcctgagaatttgattaagatagaggaagaagagtccagcgaaagcgaaccaggaacgattatgaaacaaagtccaggtgccggaacgacttatgatgtgagtaaacctactcaaattgtcttgacagtagctaaaaaagttacaagtgttgccatgccgagttacattggttccagcttggagtttactaagaacaatttgattcaaattgttgggattaaggaagctaatatagaagttgtagaagtgacgacagcgcctgcaggtagtgtagaaggcatggttgttgaacaaagtcctagagcaggtgaaaaggtagacctaaataagactagagtcaagatttcaatctacaaacctaaaacaacttcagctactcct

SEQ ID NO: 16 - DNA, 867 bp, Artificial Sequence
  Construct 8: SP1650 (PsaA) nt
gctagcggaaaaaaagatacaacttctggtcaaaaactaaaagttgttgctacaaactcaatcatcgctgatattactaaaaatattgctggtgacaaaattgaccttcatagtatcgttccgattgggcaagacccacacgaatacgaaccacttcctgaagacgttaagaaaacttctgaggctgatttgattttctataacggtatcaaccttgaaacaggtggcaatgcttggtttacaaaattggtagaaaatgccaagaaaactgaaaacaaagactacttcgcagtcagcgacggcgttgatgttatctaccttgaaggtcaaaatgaaaaaggaaaagaagacccacacgcttggcttaaccttgaaaacggtattatttttgctaaaaatatcgccaaacaattgagcgccaaagaccctaacaataaagaattctatgaaaaaaatctcaaagaatatactgataagttagacaaacttgataaagaaagtaaggataaatttaataagatccctgctgaaaagaaactcattgtaaccagcgaaggagcattcaaatacttctctaaagcctatggtgtcccaagtgcctacatctgggaaatcaatactgaagaagaaggaactcctgaacaaatcaagaccttggttgaaaaacttcgccaaacaaaagttccatcactctttgtagaatcaagtgtggatgaccgtccaatgaaaactgtttctcaagacacaaacatcccaatctacgcacaaatctttactgactctatcgcagaacaaggtaaagaaggcgacagctactacagcatgatgaaatacaaccttgacaagattgctgaaggattggcaaaa

SEQ ID NO: 17 - protein, 254 aa, Artificial Sequence
  Construct 2m: SP0609 aa
LISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDTFSVDRSILSGYTSKRTALLDDSFKPSDYGIVTKKSNTELNDYLDNLVTKWSKDGSLQKLYDRYKLKPSSHTAD

SEQ ID NO: 18 - protein, 809 aa, Artificial Sequence
  Construct 5m: SP2194 aa
NYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDSNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLTEKGIDLKLQASALKLLANQGYDPEMGARPLRRTLQTEVEDKLAELLLKGDLVAGSTLKIGVKAGQLKFDIA

SEQ ID NO: 19 - DNA, 27 bp, Artificial Sequence
  ICC5875 primer
tgtgattatcatggttctagagtttga

SEQ ID NO: 20 - DNA, 24 bp, Artificial Sequence
  ICC6198 primer
tgcaaacagttattggtttttgtc

SEQ ID NO: 21 - DNA, 21 bp, Artificial Sequence
  ICC5876 primer
ggatggtttaccttagcagca

SEQ ID NO: 22 - DNA, 21 bp, Artificial Sequence
  ICC5877 primer
tgatggctatttcatcaacca

SEQ ID NO: 23 - DNA, 21 bp, Artificial Sequence
  ICC5878 primer
cgcttcttgggcatttttaag

SEQ ID NO: 24 - DNA, 20 bp, Artificial Sequence
  ICC5879 primer
cgagcatgaaggtgctgtaa

SEQ ID NO: 25 - DNA, 21 bp, Artificial Sequence
  ICC5880 primer
ccacctctaaggtccaaatcc

SEQ ID NO: 26 - DNA, 20 bp, Artificial Sequence
  ICC5881 primer
cctagcagtttccgttccaa

SEQ ID NO: 27 - DNA, 20 bp, Artificial Sequence
  ICC5882 primer
cacttgcttgaacacgctct

SEQ ID NO: 28 - DNA, 25 bp, Artificial Sequence
  ICC5883 primer
cagagtctaaaagatctggttgctt

SEQ ID NO: 29 - DNA, 22 bp, Artificial Sequence
  ICC5884 primer
tttgccatgttacaaaaactcc

SEQ ID NO: 30 - DNA, 20 bp, Artificial Sequence
  ICC5885 primer
ttgacaatccaagcgaacct

SEQ ID NO: 31 - DNA, 23 bp, Artificial Sequence
  ICC5886 primer
aagaggaaaccattgaaaaattg

SEQ ID NO: 32 - DNA, 23 bp, Artificial Sequence
  ICC5887 primer
tcatcgaaaaagttcaaggaaaa

SEQ ID NO: 33 - DNA, 20 bp, Artificial Sequence
  ICC5888 primer
cgttgacgcagtttgaagag

SEQ ID NO: 34 - DNA, 20 bp, Artificial Sequence
  ICC5889 primer
tagcgaacgctacaaaagca

SEQ ID NO: 35 - DNA, 21 bp, Artificial Sequence
  ICC5890 primer
ccagacccttggtatacagga

SEQ ID NO: 36 - DNA, 20 bp, Artificial Sequence
  ICC5891 primer
ttgcttggaagagggatttg

SEQ ID NO: 37 - DNA, 20 bp, Artificial Sequence
  ICC5892 primer
ctttggatcgcgttttagga

SEQ ID NO: 38 - DNA, 20 bp, Artificial Sequence
  ICC5893 primer
gccaaggctggtttcaagat

SEQ ID NO: 39 - DNA, 20 bp, Artificial Sequence
  ICC5894 primer
tgaagaagatggccaagtca

SEQ ID NO: 40 - DNA, 20 bp, Artificial Sequence
  ICC5895 primer
agacaccgtcatccagaacc

SEQ ID NO: 41 - DNA, 20 bp, Artificial Sequence
  ICC5896 primer
ggagctcctccaggctatgt

SEQ ID NO: 42 - DNA, 19 bp, Artificial Sequence
  ICC5897 primer
gcggctagctgcctagttt

SEQ ID NO: 43 - DNA, 20 bp, Artificial Sequence
  ICC6004 primer
aacgatccgtggttttcatc

SEQ ID NO: 44 - DNA, 28 bp, Artificial Sequence
  ICC6279 primer
gatagagctgacgtggtttgaagagatt

SEQ ID NO: 45 - protein, 1646 aa, Streptococcus pneumoniae Pj-102-59
MKNPFFERRCRYSIRKLSVGACSLMIGAVLFAGPALAEETAVPENSGANPELVSGESEHSTNEADKQNEGEHARENKLEKAEGVAIASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFALSSLAGKTIYAVKLFFEHEGAVKDYQFHLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDNLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELATAKQSLKDLVALLKEDKSAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 46 - protein, 1659 aa, Streptococcus pneumoniae Pj-102-62
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTSDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVQAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLNLSEGRFAVAYSNDTMEEHSFTDEGVEISGYDAQKTGRQTLTLRYQGHEFNFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELTFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 47 - protein, 1659 aa, Streptococcus pneumoniae Pj-102-70; identical to SEQ ID NO: 46

SEQ ID NO: 48 - protein, 1646 aa, Streptococcus pneumoniae Pj-102-77
MKNPFFERRCRYSIRKLSVGACSLMIGAVLFAGPALAEETAVPENSGANTELVSGESEHSINEADKQNEGEHTRENKLEKAEGVATASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKAYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELATAKQSLKDLVALLKEDKSAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 49 - protein, 1646 aa, Streptococcus pneumoniae Pj-102-93
MKNPFFERRCRYSIRKLSVGACSLMIGAVLFAGPALAEETAVPENSGANTELVSGESEHSTNEADKQNEGEHTRENKLEKAEGVATASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEVQELLAAKPNHPSGSALAPLLEKNKALVEKVDLSPEELTTTKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKGAVELAFEQTDSHVIFTAPHFTHYAFVYESAEKPQPAKPAPQNKVLPKPTYQPASDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 50 - protein, 1659 aa, Streptococcus pneumoniae Pj-102-94
MKNPFFERRCRYSIRKLSVGACSLMIGAVLFAGPALAEETAVPENSRANTELVSGESEHSTNEADKQNEGEHARENKLEKAEGVATASETASPASNEAATTETAEAASAAKPEEKASEVVAETPSAEAKPKSDKETEAKPEATNQGDESKPAEEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKSAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 51 - protein, 1659 aa, Streptococcus pneumoniae Pj-102-98
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHKGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 52 - protein, 1659 aa, Streptococcus pneumoniae Pj-102-148
MKNPFFERRCRYSIRKLSVGACSLMIGAVLFAGPALAEETAVPENSGANTELVSGESEHSTNEADKQNEGEHARENKLEKAEGVATASETASPASNEAATTETAEAASAAKPEEKASEVVAETPSAEAKPKSDKETEAKPEATNQGDESKPAEEANKTEKEVQPDVPKNTEKTLKPKEIKFNSWEELLKWEPGVREDDAINRGSVVLASRRTGHLVNEKASKEAKVQTLSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQIPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKNYLVGDSLDLSEGCFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHEISTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVAIQEKPAQNTAVKSEEASKQLPNTGTADANEALIAGLASLGLASLALTLRRKREDKD

SEQ ID NO: 53 - protein, 1634 aa, Streptococcus pneumoniae Pj-102-160
MKNPFFERRCRYSIRKLSVGACSLMIGAVLFAGPALAEETAVPENSGANTELVSGESEHSTNEADKQNEGEHTRENKLEKAEGVATASETAEAASAAKPEEKASEAVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTVQDVRLYSTKLEVTEKTKLRVAHKGGKGSKVYMAFSTTSDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFSDVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGKDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 54 - protein, 1659 aa, Streptococcus pneumoniae Pj-102-161
MKNPFFERRCRYSIRKLSVGACSLMIGAVLFAGPALAEETAVPENSGANTELVSGESEHSTNEADKQNKGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELTFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 55 - protein, 1659 aa, Streptococcus pneumoniae Pj-102-163
MKNPFFERRCRYSIRKLSVGACSLMIGAVLFAGPALAEETAVPENSRANTELVSGESEHSTNEADKQNEGEHARENKLEKAEGVATASETASPASNEAATTETAEAASAAKPEEKASEVVAETPSAEAKPKSDKETEAKPEATNQGDESKPAEEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKSAVFSDSKTGVEVHFSNKEKSVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 56 - protein, 1659 aa, Streptococcus pneumoniae Pj-102-174
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFTEEKTELDRLTGEVQELLAAKPNHPSGSALAPLLEKNKALVEKVDLSPEELTTAKQSLKDLVALLKEDKPAVFSDSKTGVEVHFSNKEKSVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPTSDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 57 - protein, 1659 aa, Streptococcus pneumoniae Pj-102-228
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEVQELLAAKPNHPSGSALAPLLEKNKALVEKVDLSPEELTTTKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 58 - protein, 1659 aa, Streptococcus pneumoniae Pj-102-386; identical to SEQ ID NO: 51

SEQ ID NO: 59 - protein, 1659 aa, Streptococcus pneumoniae Pj-102-468
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAEEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKSRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELATAKQSLKDLVALLKEDKSAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 60 - protein, 1659 aa, Streptococcus pneumoniae Pj-1344
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAVLASLGLASLALTLRRKREDKD

SEQ ID NO: 61 - protein, 1646 aa, Streptococcus pneumoniae Pj-1364
MKNPFFERRCRYSIRKLSVGACSLMIGAVLFVGPALAEETAVPENSGANTELVSGESEHSTNEADKQNEGEHTRENKLEKAEGVATASETAEAASAAKPEEKAGEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMVKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFALSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDVTLDKPITAQDWRLNVVTSDNGTPWKAIRIYNWKMYEKLDTESVNIPMAKAAARSLGNNKVQVGFADVPAGATITVYDNPNSPTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALILRRKREDED

SEQ ID NO: 62 - protein, 1646 aa, Streptococcus pneumoniae Pj-1484
MKNPFFERRCRYSIRKLSVGACSLMIGAVLFAGPALAEETAVPENSGANTELVSGESEHSTNEADKQNEGEHTRENKLEKAEGVATASETAEAASAAKPEEKAGEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFALSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDVTLDKPITAQDWRLNVVTSDNGTPWKAIRIYNWKMYEKLDTESVNIPMAKAAARSLGNNKVQVGFADVPAGATITVYDNPNSPTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALILRRKREDED

SEQ ID NO: 63 - protein, 1659 aa, Streptococcus pneumoniae Pj-1490
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGRKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAVLASLGLASLALTLRRKREDKD

SEQ ID NO: 64 - protein, 1659 aa, Streptococcus pneumoniae Pj-1228
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFTEEKTELDRLTGEVQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPTSDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 65 - protein, 1646 aa, Streptococcus pneumoniae Pj-1229
MKNPFFERRCRYSIRKLSVGACSLMIGAVLFAGPALAEETAVPENSGANTELVSGESEHSTNEADKQNEGEHARENKLEKAEGVATASETAEAASAAKPEEKVGEVVAETPSAEAKPKSDKETEAKPEATNQGDESKPAEEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTVQDVRLYSTKLEVTEKTKLRVAHKGGKGSKVYMAFSTTSDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFSDVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFTEEKTELDRLTGEVQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 66 - protein, 1659 aa, Streptococcus pneumoniae Pj-1230
MKNPFFERRCRYSIRKLSVGACSLMIGAVLFAGPALAEETAVPENSGANTELVSGESEHSTNEADKQNEGEHARENKLEKAEAVATASETASPASNEAATTETAEAASAAKPEEKAGEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFEWGMTVQDTSLPRPLAENIVPGATVIGSTFPDTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEFNFDVLVSPKAALNDEYLKQKLAEVEAAKNKVVYNFASPEVKEAFLKAIEAAEQVLKDRETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVALSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQDHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 67 - protein, 1646 aa, Streptococcus pneumoniae Pj-1231
MKNPFFERRCRYSIRKLSVGACSLMIGAVLFAGPALAEETAVPENSGANPELVSGESEHSTNEADKQNEGEHARENKLEKAEGVAIASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFALSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDNLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELATAKQSLKDLVALLKEDKSAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 68 - protein, 1659 aa, Streptococcus pneumoniae Pj-1232
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAEEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELATAKQSLKYLVALLKEDKSAVFSDSKTGVEVHFSNKEKTVIKGLKVERVQASAEEKKYFAGEDAHVFEIEGLDEKGQDVDLSYASIVKIPIEKDKKVKKVFFLPEGKEAVELTFEQTDSHVIFTASHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 69 - protein, 1646 aa, Streptococcus pneumoniae Pj-1233
MKNPFFERRCRYSIRKLSVGACSLMIGAVLFVGPALAEETAVPENSGANTELVSGESEHSTNEADKQNEGEHTRENKLEKAEGVATASETAEAASAAKPEEKAGEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFALSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDVTLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVQKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHIIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 70 - protein, 1659 aa, Streptococcus pneumoniae Pj-1234
MKNPFFERRCRYSIRKLSVGACSLMIGAVLFVGPALAEETAVPENSGANTELVSGESEHSTNEADKQNEGEHTRENKLEKAEGVATASETASPASNEAATTETAEAASAAKPEEKAGEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFALSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDVTLDKPITAQDWRLNVVTSDNGTPWKAIRIYNWKMYEKLDTESVNIPMAKAAARSLGNNKVQVGFADVPAGATITVYDNPNSPTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALILRRKREDED

SEQ ID NO: 71 - protein, 1636 aa, Streptococcus pneumoniae Pj-1236
MKNPFFERRCRYSIRKLSVGACSLMIGAVLFAGPALAEETAVPENSGANTELVSGESEHSTNEADKQNEGEHARENKLEKAEAASAAKPEEKAGEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYRFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFEWGMTVQDTSLPRPLAENIVPGATVIGSTFPDTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGWDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 72 - protein, 1659 aa, Streptococcus pneumoniae Pj-1237; identical to SEQ ID NO: 50

SEQ ID NO: 73 - protein, 1646 aa, Streptococcus pneumoniae Pj-1241
MKNPFFERRCRYSIRKLSVGACSLMIGAVLFAGPALAEETAVPENSGANTELVSGESEHSTNEADKQNEGEHARENKLEKAEGVATASETAEAASAAKPEEKASEVIAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDNWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDVTLDKPITAQDWRLNVVTSDNGTPWKAIRIYNWKMYEKLDTESVNIPMAKVAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEVFLKAIEAAEQVLKDHETSTQDQVNDRLNKLTEAHKALNGQEKFKEEKTELDRLTGEVQELLAAKPNHPSGSALAPLLEKNKVLVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 74 - protein, 1659 aa, Streptococcus pneumoniae Pj-1242; identical to SEQ ID NO: 59

SEQ ID NO: 75 - protein, 1646 aa, Streptococcus pneumoniae Pj-1248
MKNPFFERRCRYSIRKLSVGACSLMIGAVLFAGPALAEETAVPENSGANTELVSGESEHSTNEADKQNEGEHTRENKLEKAEGVATASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFTEEKTELDRLTGEVQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPTSDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 76 - protein, 1659 aa, Streptococcus pneumoniae Pj-1250; identical to SEQ ID NO: 51

SEQ ID NO: 77 - protein, 1646 aa, Streptococcus pneumoniae Pj-1255
MKNPFFERRCRYSIRKLSVGACSLMIGAVLFAGPALAEETAVPENSGANTELVSGESEHSTNEADKQNEGEHTRENKLEKAEGVATASETAEAASAAKPEEKASEAVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTVQDVRLYSTKLEVTEKTKLRVAHKGGKGSKVYMAFSTTSDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFSDVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGKDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 78 - protein, 1636 aa, Streptococcus pneumoniae Pj-1262
MKNPFFERRCRYSIRKLSVGACSLMIGAVLFAGPALAEETAVPENSGANTELVSGESEHSTNEADKQNEGEHARENKLEKAEAASAAKPEEKAGEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYRFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFEWGMTVQDTSLPRPLAENIVPGATVIGSTFPDTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 79 - protein, 1659 aa, Streptococcus pneumoniae Pj-1279
MKNPFFERRCRYSIRKLSVGACSLMIGAVLFAGPALAEETAVPENSGANTELVSGESEHSTNEADKQNEGEHARENKLEKAEGVATASETASPASNEAATTETAEAASATKPEEKASEVVAETPSVEAKPKSDKETEAKPEATNQGDESKPAAEANKTEKEVQSDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFALSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASPEVKEAFLKAIEAAEQVLKDHEISTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDEKGQRRLRSTEVIQEAIPEIVEIGTKVKTVPAVVATQEKPAQNTAVKSEEASKQLPNTGTADANETLIAGLASLGLASLALTLRRKREDKD

SEQ ID NO: 80 - protein, 1646 aa, Streptococcus pneumoniae Pj-1283
MKNPFFERRCRYSIRKLSVGACSLMIGAVLFAGPALAEETAVPENSGANTELVSGESEHSTNEADKQNEGEHARENKLEKAEGVAIASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFALSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDNLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELATAKQSLKDLVALLKEDKSAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 81 - protein, 1659 aa, Streptococcus pneumoniae Pj-1284
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 82 - protein, 1659 aa, Streptococcus pneumoniae Pj-1291
MKNPFFERRCRYSIRKLSVGACSLMIGAVLFAGPALAEETAVPENSGANTELVSGESEHSTNEADKQNEGEHARENKLEKAEGVATASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKSRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELATAKQSLKDLVALLKEDKSAVFSDSKTGVEVHFSNKEKTVIKGLKVERVQASAEEKKYFAGEDAHVFEIEGLDEKGQDVDLSYASIVKIPIEKDKKVKKVFFLPEGKGAVELAFEQTDSHVIFTAPHFTHYAFVYESAEKPQPAKPAPQNKVLPKPTYQPASDQQKAPKLEVQEEKVAFHRQEHENTEMLVGEQRVIIQGRDGLLRHVFEVDEKGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 83 - protein, 1646 aa, Streptococcus pneumoniae Pj-1297
MKNPFFERRCRYSIRKLSVGACSLMIGAVLFAGPALAEETAVPENSGANTELVSGESEHSTNEADKQNEGEHTRENKLEKAEGVATASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDNWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDVTLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLATKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 84 - protein, 1682 aa, Streptococcus pneumoniae Pj-1298
MKNPFFERRCRYSIRKLSVGACSLMIGAVLFAGPALAEETAVPENSGANPELVSGESEHSTNEADKQNEGEHARENKLEKAEGVAIASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFALSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDNLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFTEEKTELDRLTGEAQELLAAKPNHPSGSALAPLLEKNKALVEKVDLSPEELATAKQSLKDLVALLKEDKSAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 85 - protein, 1636 aa, Streptococcus pneumoniae Pj-1300
MKNPFFERRCRYSIRKLSVGACSLMIGAVLFAGPALAEETAVPENSGANTELVSGESEHSTNEADKQNEGEHARENKLEKAEAASAAKPEEKAGEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFEWGMTVQDTSLPRPLAENIVPGATVIGSTFPDTEGGEGIEGMLNGTITSLSDKWSSAQLSGSVDIRLTKPRTVVRWVMDHAGAGGESVNDGLMNTKDFDLYYKDADGKWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKEAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 86 - protein, 1646 aa, Streptococcus pneumoniae Pj-1322
MKNPFFERRCRYSIRKLSVGACSLMIGAVLFAGPALAEETAVPENSGANTELVSGESEHSTNEADKQNEGEHTRENKLEKAEGVATASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQKPKKNYLVGDSLDLSEGRFAVAYSNDTMEEHSFTDEGVEISGYDAQKIGRQTLTLRYQGHEVNFDVLVSPKAALNDEYLKQKLAEVEAAKNKVVYNFASPEVKEAFLKAIEAAEQVLKDHEISTQDQVNDRLNKLTEAHKALNGQEKFKEEKTELDRLTGEVQELLDAKPNHPSGSALAPLLEKNKVLVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 87 - protein, 1646 aa, Streptococcus pneumoniae Pj-1330; identical to SEQ ID NO: 75

SEQ ID NO: 88 - protein, 1659 aa, Streptococcus pneumoniae Pj-1347
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAEEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKSRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEVNFDVLVSPKAALNDEYLKQKLAEVEAAKNKVVYNFASPEVKAAFLKAIEAAEQVLKDHEISTQDQVNDRLNKLTEAHKALNGQEKFKEEKTELDRLTGEVQELLDAKPNHPSGSALAPLLEKNKVLVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 89 - protein, 1646 aa, Streptococcus pneumoniae Pj-1369
MKNPFFERRCRYSIRKLSVGACSLMIGAVLFAGPALAEETAVPENSGANTELVSGESEHSTNEADKQNEGEHTRENKLEKAEGVATASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPVDNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDNWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFSDVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNELTEAHKALNGQEKFTEEKTELDRLTGEVQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPTSDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 90 - protein, 1646 aa, Streptococcus pneumoniae Pj-1386; identical to SEQ ID NO: 67

SEQ ID NO: 91 - protein, 1646 aa, Streptococcus pneumoniae PBI-71
MKNPFFERRCRYSIRKLSVGACSLMIGAVLFAGPALAEETAVPENSGANTELVSGESEHSTNEADKQNEGEHARENKLEKAEGVATASETAEAASAAKPEEKAGEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQIPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHEISTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENAEMLVGEQRVIIQGRDGLLRHVFEVDENGQRRLRSTEVIQEAIPEIVEIGTKVKTVPAIVATQEKPAQNTAVKSEEASKQLPNTGTADANEALIAGLASLGLASLALTLRRKREDKD

SEQ ID NO: 92 - protein, 1659 aa, Streptococcus pneumoniae TIGR4_DB
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFTEEKTELDRLTGEVQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPTSDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 93 - protein, 1659 aa, Streptococcus pneumoniae TIGR4_IC; identical to SEQ ID NO: 92

SEQ ID NO: 94 - protein, 264 aa, Streptococcus pneumoniae Pj-102-59
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDAFSVDRSILSGYTNKRTALLDDSFKPSDYGIVTKKSNTELNDYLDNLVTKWSKDGSLQKLYDRYKLKPSSHTAD

SEQ ID NO: 95 - protein, 264 aa, Streptococcus pneumoniae Pj-102-77
MKKKFFLSALLISLFGLVAAKPVQANTSIADIQKRGELVVGVKQDVPNFGYKDPKTGTYSGIETDLAKMVADELKVKIHYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDAFSVDRSILSGYTSKRTELLDDSFKPSDYGIVTKKSNTELNDYLDNLVTKWSKDGSLQKLYDRYKLKPSSHTAD

SEQ ID NO: 96 - protein, 264 aa, Streptococcus pneumoniae Pj-102-93
MKKKFFLSALLISLFGLAAAKPVQADTSIADIQKRGELVVGVKQDVPNFGYKDPKTGTYSGIETDLAKIVADELKVKIRYVPVTAQTRGPLLDNEQVDMDIATFTITDERKKLYNFTSPYYTDASGFLVNKSAKIKKIEDLNGKTIGVAQGSITQRLITELGKKKGLTFKFVELGSYPELITSLHAHRIDAFSVDRSILSGYTSKRTELLDDSFKPSDYGIVTKKSNTELNDYLDTLVTKWSKDGSLQKLYDRYKLKPSSHTAD

SEQ ID NO: 97 - protein, 264 aa, Streptococcus pneumoniae Pj-102-94
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNSKTIGVAQGSITQCLITELGKKKGLTFKFVELGSYPELITSLHAHRIDAFSVDRSILSGYTSKRTELLDDSFKPSDYGIVTKKSNTELNDYLDNLVTKWSKDGSLQKLYDRYKLKPSSHTAD

SEQ ID NO: 98 - protein, 264 aa, Streptococcus pneumoniae Pj-102-98; identical to SEQ ID NO: 94

SEQ ID NO: 99 - protein, 264 aa, Streptococcus pneumoniae Pj-102-148
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQSSITQRLITELGKKKGLTFKFVELGSYPELITSLHAHRIDAFSVDRSILSGYTSKRTALLDDSFKPSDYGIVTKKSNTELNDYLDNLVTKWSKDGSLQKLYDRYKLKPSSHTAD

SEQ ID NO: 100 - protein, 264 aa, Streptococcus pneumoniae Pj-102-160
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDTFSVDRSILSGYTSKRTALLDDSFKPSDYGIVTKKSNTELNDYLDTLVTKWSKDGSLQKLYDRYKLKPSSHTAD

SEQ ID NO: 101 - protein, 264 aa, Streptococcus pneumoniae Pj-102-161; identical to SEQ ID NO: 100

SEQ ID NO: 102 - protein, 264 aa, Streptococcus pneumoniae Pj-102-163; identical to SEQ ID NO: 97

SEQ ID NO: 103 - protein, 264 aa, Streptococcus pneumoniae Pj-102-228; identical to SEQ ID NO: 96

SEQ ID NO: 104 - protein, 264 aa, Streptococcus pneumoniae Pj-102-386; identical to SEQ ID NO: 94

SEQ ID NO: 105 - protein, 264 aa, Streptococcus pneumoniae Pj-1344
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDAFSVDRSILSGYTSKRTELLDDSFKPSDYGIVTKKSNTELNDYLDNLVTKWSKDGSLQKLYDRYKLKPSSHTAD

SEQ ID NO: 106 - protein, 264 aa, Streptococcus pneumoniae Pj-1490; identical to SEQ ID NO: 105

SEQ ID NO: 107 - protein, 264 aa, Streptococcus pneumoniae Pj-1228; identical to SEQ ID NO: 105

SEQ ID NO: 108 - protein, 264 aa, Streptococcus pneumoniae Pj-1229
MKKKFFLSALLISLFSLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDTFSVDRSILSGYTSKRTALLDDSFKPSDYGIVTKKSNTELNDYLDNLVTKWSKDGSLQKLYDRYKLKPSSHTAD

SEQ ID NO: 109 - protein, 264 aa, Streptococcus pneumoniae Pj-1230; identical to SEQ ID NO: 95

SEQ ID NO: 110 - protein, 264 aa, Streptococcus pneumoniae Pj-1231; identical to SEQ ID NO: 94

SEQ ID NO: 111 - protein, 264 aa, Streptococcus pneumoniae Pj-1232
MKKKFFLSALLISLFGLVAAKPVQANTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLTFKFVELGSYPELITSLHAHRIDAFSVDRSILSGYTSKRTELLDDSFKPSDYGIVTKKSNTELNDYLDNLVTKWSKDGSLQKLYDRYKLKPSSHTAD

SEQ ID NO: 112 - protein, 264 aa, Streptococcus pneumoniae Pj-1233
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQCLITELGKKKGLTFKFVELGSYPELITSLHAHRIDAFSVDRSILSGYTSKRTELLDDSFKPSDYGIVTKKSNTELNDYLDNLVTKWSKDGSLQKLYDRYKLKPSSHTAD

SEQ ID NO: 113 - protein, 264 aa, Streptococcus pneumoniae Pj-1236
MKKKFFLSALLISLFGLAAAKPVQADTSIADIQKRGELVVGVKQDVPNFGYKDPKTGTYSGIETDLAKMVADELKVKIRYVPVTAQTRGPLLDNEQGDMDIATFTITDERKKLYNFTSPYYTDASGFLVNKSAKIKKIEDLNGKTIGVAQGSITQRLITELGKKKGLKFKFVELGSYPELITSLHAHRIDAFSVDRSILSGYTSKRTALLDDSFKPSDYGIVTKKSNTEFNDYLDNLVTKWSKDGSLQKLYDRYKLKPSSHTAD

SEQ ID NO: 114 - protein, 264 aa, Streptococcus pneumoniae Pj-1237; identical to SEQ ID NO: 97

SEQ ID NO: 115 - protein, 264 aa, Streptococcus pneumoniae Pj-1241; identical to SEQ ID NO: 94

SEQ ID NO: 116 - protein, 264 aa, Streptococcus pneumoniae Pj-1242
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKDLKFKFVELGSYPELITSLHAHRIDAFSVDRSILSGYTNKRTALLDDSFKPSDYGIVTKKSNTELNDYLDNLVTKWSKDGSLQKLYDRYKLKPSSHTAD

SEQ ID NO: 117 - protein, 264 aa, Streptococcus pneumoniae Pj-1248; identical to SEQ ID NO: 113

SEQ ID NO: 118 - protein, 264 aa, Streptococcus pneumoniae Pj-1250
MKKKFFLSALLISLFGLAAAKPVQADTSIADIQKRGELVVGVKQDVPNFGYKDPKTGTYSGIETDLAKMVADELKVKIRYVPVTAQTRAPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDAFSVDRSILSGYTNKRTALLDDSFKPSDYGIVTKKSNTELNDYLDNLVTKWSKDGSLQKLYDRYKLKPSSHTAD

SEQ ID NO: 119 - protein, 264 aa, Streptococcus pneumoniae Pj-1255; identical to SEQ ID NO: 100

SEQ ID NO: 120 - protein, 264 aa, Streptococcus pneumoniae Pj-1262; identical to SEQ ID NO: 113

SEQ ID NO: 121 - protein, 264 aa, Streptococcus pneumoniae Pj-1279
MKKKFFLSALLISLFGLAAAKPVQADTNIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDTFSVDRSILSGYTSKRTALLDDSFKPSDYGIVTKKSNTELNDYLDNLVTKWSKDGSLQKLYDRYKLKPSSHTAD

SEQ ID NO: 122 - protein, 264 aa, Streptococcus pneumoniae Pj-1283; identical to SEQ ID NO: 94

SEQ ID NO: 123 - protein, 264 aa, Streptococcus pneumoniae Pj-1284; identical to SEQ ID NO: 111

SEQ ID NO: 124 - protein, 264 aa, Streptococcus pneumoniae Pj-1297
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNSKTIGVAQSSITQCLITELGKKKGLTFKFVELGSYPELITSLHAHRIDAFSVDRSILSGYTSKRTELLDDSFKPSDYGIVTKKSNTELNDYLDNLVTKWSKDGSLQKLYDRYKLKPSSHTAD

SEQ ID NO: 125 - protein, 264 aa, Streptococcus pneumoniae Pj-1298; identical to SEQ ID NO: 94

SEQ ID NO: 126 - protein, 264 aa, Streptococcus pneumoniae Pj-1300; identical to SEQ ID NO: 94

SEQ ID NO: 127 - protein, 264 aa, Streptococcus pneumoniae Pj-1322
MKKKFFLSALLISLFGLAAAKPVQADTSIADIQKRGELVVDVKQDVPNFGYKDPKTGTYSGIETDLAKMVADELKVKIRYVPVTAQTRGPLLDHEQVDMDIATFTITDERKKLYNFTSPYYTDASGFLVNKSAKIKKIEDLNGKTIGVAQGSITQRLITELGKKKGLTFKFVELGSYPELITSLHAHRIDAFSVDRSILSGYTSKRTELLDDSFKPSDYGIVTKKSNTELNNYLDNLVTKWSKDGSLQKLYGRYKLKPSSHTAD

SEQ ID NO: 128 - protein, 264 aa, Streptococcus pneumoniae Pj-1330; identical to SEQ ID NO: 113

SEQ ID NO: 129 - protein, 264 aa, Streptococcus pneumoniae Pj-1345; identical to SEQ ID NO: 97

SEQ ID NO: 130 - protein, 264 aa, Streptococcus pneumoniae Pj-1369; identical to SEQ ID NO: 111

SEQ ID NO: 131 - protein, 264 aa, Streptococcus pneumoniae Pj-1386; identical to SEQ ID NO: 94

SEQ ID NO: 132 - protein, 264 aa, Streptococcus pneumoniae PBI-71
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLTFKFVELGSYPELITSLHAHRIDAFSVDRSILSGYTNKRTALLDDSFKPSDYGIVTKKSNTELNDYLDNLVTKWSKDGSLQKLYDRYKLKPSSHTAD

SEQ ID NO: 133 - protein, 264 aa, Streptococcus pneumoniae I-33_Andersson
MKKKFFLSALLISLLGLAAAKPVQADTSVADIQKRGELVVGVKQDVPNFGYKDPKTGTYSGIETDLAKMVADELKVKVRYVPVTAQTRGPLLDNEQVDMDIATFTITDERKKLYNFTSPYYTDASGFLVNKSAKIKSIEDLNGKTIGVAQGSITQRLITELGKKKGLKFKFVELGSYPELITSLHAHRIDAFSVDRSILSGYISKRTVLLDDSFKPSDYGIVTKKSNTELNDYLDNLVTKWSKDGSLQKLYDRYKLKPSSHTAD

SEQ ID NO: 134 - protein, 264 aa, Streptococcus pneumoniae Pj-1291_Andersson
MKKKFFLYALLISLFSLTAAKPVQADTSVADIQKRGELVVGVKQDVPNFGYKDPKTGSYSGIETDLAKMIADELKVKVRYVPVTAQTRGPLLDNEQVDMDIATFTITDERKKLYNFTSPYYTDASGFLVNKSANIKSIEDLNGKTIGVAQGSITQRLITELGKKKGLTFKFVELGSYPELITSLHAHRIDAFSVDRSILSGYISKRTELLDDSFKPSDYGIVTKKSNTELNDYFDQLVTKWSKDGSLQKLYDRYKLKPSSHTAD

SEQ ID NO: 135 - protein, 264 aa, Streptococcus pneumoniae TIGR4_DB
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDTFSVDRSILSGYTSKRTALLDDSFKPSDYGIVTKKSNTELNDYLDNLVTKWSKDGSLQKLYDRYKLKPSSHTAD

SEQ ID NO: 136 - protein, 264 aa, Streptococcus pneumoniae TIGR4_IC; identical to SEQ ID NO: 135

SEQ ID NO: 137 - protein, 386 aa, Streptococcus pneumoniae Pj-102-62
MKKKFALSFVALASVALLAACGEVKSGAVNTAGNSVEEKTIKIGFNFEESGSLAAYGTAEQKGAQLAVDEINAAGGIDGKQIEVIDKDNKSETAEAASVTTNLVTQSKVSAVVGPATSGATAAAVSNATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATVEKASNIYFISGFSTTVEVSAKAKAFLDAYRAKYNEEPSTFAALAYDSVHLVANAAKGAKNSGEIKDNLAKTKDFEGVTGQTSFDADHNTVKTAYMMTMNNGKVEAAEVVKP

SEQ ID NO: 138 - protein, 386 aa, Streptococcus pneumoniae Pj-102-70; identical to SEQ ID NO: 137

SEQ ID NO: 139 - protein, 386 aa, Streptococcus pneumoniae Pj-102-77
MKKKFALSFVALASVALLAACGEVKSGAVNTAGNSVEEKTIKIGFNFEESGSLAAYGTAEQKGAQLAVDEINAAGGIDGKQIEVIDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKDNLAKTKDFEGVTGQTSFDADHNTVKTAYMMTMNNGKVEAAEVVKP

SEQ ID NO: 140 - protein, 386 aa, Streptococcus pneumoniae Pj-102-93
MKKKFALSFVALASVALLAACGEVKSGAVNTAGNSVEEKTIKIGFNFEESGSLAAYGTAEQKGAQLAVDEINAAGGIDGKQIEVIDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGRDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADHNTVKTAYMMTMNNGKVEAAEVVKP

SEQ ID NO: 141 - protein, 386 aa, Streptococcus pneumoniae Pj-102-98
MKKKFALSFVALASVALLAACGEVKSGAVNTAGNSVEEKTIKIGFNFEESGSLAAYGTAEQKGAQLAVDEINAAGGIDGKQIEVVDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKDNLAKTKDFEGVTGQTSFDADHNTVKTAYMMTMNNGKVEAAEVVKP

SEQ ID NO: 142 - protein, 386 aa, Streptococcus pneumoniae Pj-102-148; identical to SEQ ID NO: 141

SEQ ID NO: 143 - protein, 386 aa, Streptococcus pneumoniae Pj-102-160; identical to SEQ ID NO: 141

SEQ ID NO: 144 - protein, 386 aa, Streptococcus pneumoniae Pj-102-161; identical to SEQ ID NO: 140

SEQ ID NO: 145 - protein, 386 aa, Streptococcus pneumoniae Pj-102-386; identical to SEQ ID NO: 141

SEQ ID NO: 146 - protein, 386 aa, Streptococcus pneumoniae Pj-1344
MKKKFALSFVALASVALLAACVEVKSGAVNTAGNSVEEKTIKIGFNFEESGSLAAYGTAEQKGAQLAVDEINAAGGIDGKQIEVVDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTNMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKDNLAKTKDFEGVTGQTSFDADHNTVKTAYMMTMNNGKVEAAEVVKP

SEQ ID NO: 147 - protein, 386 aa, Streptococcus pneumoniae Pj-1490; identical to SEQ ID NO: 146

SEQ ID NO: 148 - protein, 386 aa, Streptococcus pneumoniae Pj-1228; identical to SEQ ID NO: 146

SEQ ID NO: 149 - protein, 386 aa, Streptococcus pneumoniae Pj-1230; identical to SEQ ID NO: 139

SEQ ID NO: 150 - protein, 386 aa, Streptococcus pneumoniae Pj-1231
MKKKFALSFVALASVALLAACGEVKSGAVNTAGNSVEEKTIKIGFNFEESGSLAAYGTAEQKGAQLAVDEINGAGGIDGKQIEVVDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADHNTVKTAYMMTMNNGKVEAAEVVKP

SEQ ID NO: 151 - protein, 386 aa, Streptococcus pneumoniae Pj-1232; identical to SEQ ID NO: 141

SEQ ID NO: 152 - protein, 386 aa, Streptococcus pneumoniae Pj-1233; identical to SEQ ID NO: 139

SEQ ID NO: 153 - protein, 386 aa, Streptococcus pneumoniae Pj-1236; identical to SEQ ID NO: 141

SEQ ID NO: 154 - protein, 386 aa, Streptococcus pneumoniae Pj-1250; identical to SEQ ID NO: 141

SEQ ID NO: 155 - protein, 386 aa, Streptococcus pneumoniae Pj-1255; identical to SEQ ID NO: 141

SEQ ID NO: 156 - protein, 386 aa, Streptococcus pneumoniae Pj-1262; identical to SEQ ID NO: 141

SEQ ID NO: 157 - protein, 386 aa, Streptococcus pneumoniae Pj-1279
MKKKFALSFVALASVALLAACGEVKSGAVNTAGNSVEEKTIKIGFNFEESGSLAAYGTAEQKGAQLAVDEINAAGGIDGKQIEVIDKDNKSETAEAASVTTNLVTQSKVSAVVGPATSGATAVAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGRDFDAIVVPGYYNEAGKIVNQARGKGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADHNTVKTAYMMTMNNGKVEAAEVVKP

SEQ ID NO: 158 - protein, 386 aa, Streptococcus pneumoniae Pj-1283
MKKKFALSFVALASVALLAACGEVKSGAVNTAGNSVEEKTIKIGFNFEESGSLAAYGTAEQKGAQLAVDEINAAGGIDGKQIEVVDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADYNTVKTAYMMTMNNGKVEAAEVVKP

SEQ ID NO: 159 - protein, 386 aa, Streptococcus pneumoniae Pj-1284; identical to SEQ ID NO: 141

SEQ ID NO: 160 - protein, 386 aa, Streptococcus pneumoniae Pj-1291; identical to SEQ ID NO: 141

SEQ ID NO: 161 - protein, 386 aa, Streptococcus pneumoniae Pj-1297; identical to SEQ ID NO: 141

SEQ ID NO: 162 - protein, 386 aa, Streptococcus pneumoniae Pj-1298; identical to SEQ ID NO: 150

SEQ ID NO: 163 - protein, 386 aa, Streptococcus pneumoniae Pj-1300
MKKKFALSFVALASVALLAACGEVKSGAVNTAGNSVEEKTIKIGFNFEESGSLAAYGTAEQKGAQLAVDEINAAGGIDGKQIEVVDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKDSLAKTKDFEGVTGQTSFDADHNTVKTAYMMTMNNGKVEAAEVVKP

SEQ ID NO: 164 - protein, 386 aa, Streptococcus pneumoniae Pj-1322
MKKKFALSFVALASVALLAACGEVKSGAVNTAGNSVEEKTIKIGFNFEESGSLAAYGTAEQKGAQLAVDEINAAGGIDGKQIEVVDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADHNTVKTAYMMTMNNGKVEAAEVVKS

SEQ ID NO: 165 - protein, 386 aa, Streptococcus pneumoniae Pj-1330; identical to SEQ ID NO: 141

SEQ ID NO: 166 - protein, 386 aa, Streptococcus pneumoniae Pj-1345; identical to SEQ ID NO: 141

SEQ ID NO: 167 - protein, 386 aa, Streptococcus pneumoniae Pj-1347; identical to SEQ ID NO: 141

SEQ ID NO: 168 - protein, 386 aa, Streptococcus pneumoniae Pj-1369; identical to SEQ ID NO: 141

SEQ ID NO: 169 - protein, 386 aa, Streptococcus pneumoniae PBI-71; identical to SEQ ID NO: 141

SEQ ID NO: 170 - protein, 386 aa, Streptococcus pneumoniae Pj-1291_Andersson; identical to SEQ ID NO: 141

SEQ ID NO: 171 - protein, 386 aa, Streptococcus pneumoniae TIGR4_DB
MKKKFALSFVALASVALLAACGEVKSGAVNTAGNSVEEKTIKIGFNFEESGSLAAYGTAEQKGAQLAVDEINAAGGIDGKQIEVVDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADHNTVKTAYMMTMNNGKVEAAEVVKP

SEQ ID NO: 172 - protein, 386 aa, Streptococcus pneumoniae TIGR4_IC; identical to SEQ ID NO: 171

SEQ ID NO: 173 - protein, 136 aa, Streptococcus pneumoniae Pj-102-148
VENLTNFYEKYRVYLTRPRLELLAVVTIVFCAVLVFFLNIPGKGVLKLDNGTIVYDGSLVRGKMNGQGTITFQNGDQYTGGFNNGSFNGKGTFQSKEGWTYEGDFVNGQAEGKGKLTTEQEVVYEGTFKQGVFQQK

SEQ ID NO: 174 - protein, 136 aa, Streptococcus pneumoniae Pj-102-161
VENLTNFYEKYRVYLTRPRLEILAVVTIVFCAVLVFFLNIPGKGVLKLDNGTIVYDGSLVRGKMNGQGTITFQNGDQYTGGFNNGAFNGKGTFQSKEGWTYEGDFVNGQAEGKGKLTTEQEVVYEGTFKQGVFQQK

SEQ ID NO: 175 - protein, 136 aa, Streptococcus pneumoniae Pj-1364
VENLTNFYEKYRVYLTRPRLEILTVVTIVFCAVLVFFLNIPGKGVLKLDNGTIVYDGSLVRGKMNGQGTITFQNGDQYTGGFNNGAFNGKGTFQSKEGWTYEGDFVNGQAEGKGKLTTEQEVVYEGTFKQGVFQQK

SEQ ID NO: 176 - protein, 136 aa, Streptococcus pneumoniae Pj-1484; identical to SEQ ID NO: 175

SEQ ID NO: 177 - protein, 136 aa, Streptococcus pneumoniae Pj-1231
VENPTNFYEKYRVYLTRPRLELLAVVTIVFCAVLVFFLNIPGKGVLKLDNGTIVYDGSLVRGKMNGQGTITFQNGDQYTGGFNNGAFNGKGTFQSKEGWTYEGDFVNGQAEGKGKLTTEQEVVYEGTFKQGVFQQK

SEQ ID NO: 178 - protein, 136 aa, Streptococcus pneumoniae Pj-1234; identical to SEQ ID NO: 175

SEQ ID NO: 179 - protein, 136 aa, Streptococcus pneumoniae Pj-1255; identical to SEQ ID NO: 174

SEQ ID NO: 180 - protein, 136 aa, Streptococcus pneumoniae Pj-1284; identical to SEQ ID NO: 175

SEQ ID NO: 181 - protein, 136 aa, Streptococcus pneumoniae Pj-1298; identical to SEQ ID NO: 177

SEQ ID NO: 182 - protein, 136 aa, Streptococcus pneumoniae Pj-1300; identical to SEQ ID NO: 174

SEQ ID NO: 183 - protein, 136 aa, Streptococcus pneumoniae Pj-1322; identical to SEQ ID NO: 177

SEQ ID NO: 184 - protein, 136 aa, Streptococcus pneumoniae I-33_Andersson
MENLKNFYEKYRVYLTRQRLELLAVVTIVFCAVLVFFLNIPGKGVLKLDNGTIVYDGSLVRGKMNGQGTITFQNGDQYTGGFNNGAFNGKGTFQSKEGWTYEGDFVNGQAEGKGKLTTEQEVVYEGTFKQGVFQQK

SEQ ID NO: 185 - protein, 136 aa, Streptococcus pneumoniae TIGR4_DB
VENLTNFYEKYRVYLTRPRLELLAVVTIVFCAVLVFFLNIPGKGVLKLDNGTIVYDGSLVRGKMNGQGTITFQNGDQYTGGFNNGAFNGKGTFQSKEGWTYEGDFVNGQAEGKGKLTTEQEVVYEGTFKQGVFQQK

SEQ ID NO: 186 - protein, 136 aa, Streptococcus pneumoniae TIGR4_IC; identical to SEQ ID NO: 185

SEQ ID NO: 187 - protein, 810 aa, Streptococcus pneumoniae Pj-102-70
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDSNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGSTLKIGVKAGQLKFDIA

SEQ ID NO: 188 - protein, 810 aa, Streptococcus pneumoniae Pj-102-93
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDSNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKYVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGSTLKIGVKAGQLKFDIA

SEQ ID NO: 189 - protein, 810 aa, Streptococcus pneumoniae Pj-102-161
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDSNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGNTLKIGVKAGQLKFDIA

SEQ ID NO: 190 - protein, 810 aa, Streptococcus pneumoniae Pj-102-228
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKSKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEALFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQVYDPEMGARPLRRTLQTEVEDKLAELLLKGDLVAGSTLKIGVKAGQLKFDIA

SEQ ID NO: 191 - protein, 810 aa, Streptococcus pneumoniae Pj-1364
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGNTLKIGVKAGQLKFDIA

SEQ ID NO: 192 - protein, 810 aa, Streptococcus pneumoniae Pj-1484; identical to SEQ ID NO: 189

SEQ ID NO: 193 - protein, 810 aa, Streptococcus pneumoniae Pj-1230
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKSKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDLEMGARPLRRTLQTEVEDKLAELLLKGDLVAGSTLKIGVKAGQLKFDIA

SEQ ID NO: 194 - protein, 810 aa, Streptococcus pneumoniae Pj-1231
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGSTLKIGVKAGQLKFDIA

SEQ ID NO: 195 - protein, 810 aa, Streptococcus pneumoniae Pj-1232
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDSNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVAFHSLSSDHMQEVVKIMVKPLVASLAEKGIDLKLQASALKLLANQGYDPEMGARPLRRTLQTEVEDKLAELLLKGDLVAGNTLKIGVKAGQLKFDIA

SEQ ID NO: 196 - protein, 810 aa, Streptococcus pneumoniae Pj-1234
MNYLKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGNTLKIGVKAGQLKFDIA

SEQ ID NO: 197 - protein, 810 aa, Streptococcus pneumoniae Pj-1236
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKSKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGSTLKIGVKAGQLKFDIA

SEQ ID NO: 198 - protein, 810 aa, Streptococcus pneumoniae Pj-1237
MNYSKALNECIESAYMVAGHFGARYLESWHLLIAMSNHSYSVAGATLNDYPYELDRLEEVALELTETDYSQDETFTELPFSRRLQILFDESEYVASVVHAKVLGTEHVLYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKCIDLKLQASALKLLANQGYDPEMGARPLRRTLQTEVEDKLAELLLKGDLVAGSTLKIGVKAGQLKFDIA

SEQ ID NO: 199 - protein, 810 aa, Streptococcus pneumoniae Pj-1241
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVSAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGSTLKIGVKAGQLKFDIA

SEQ ID NO: 200 - protein, 810 aa, Streptococcus pneumoniae Pj-1250
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVFYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMANMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKYVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGSTLKIGVKAGQLKFDIA

SEQ ID NO: 201 - protein, 810 aa, Streptococcus pneumoniae Pj-1262; identical to SEQ ID NO: 197

SEQ ID NO: 202 - protein, 810 aa, Streptococcus pneumoniae Pj-1283; identical to SEQ ID NO: 194

SEQ ID NO: 203 - protein, 810 aa, Streptococcus pneumoniae Pj-1284
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVFYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGSTLKIGVKAGQLKFDIA

SEQ ID NO: 204 - protein, 810 aa, Streptococcus pneumoniae Pj-1291; identical to SEQ ID NO: 194

SEQ ID NO: 205 - protein, 810 aa, Streptococcus pneumoniae TIGR4_IC
MNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVLYAILHDSNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLELDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATALRDDKTVGFGAKDIRFDQENMEKRMFEELKKAYRPEFINRIDEKVVFHSLSSDHMQEVVKIMVKPLVASLTEKGIDLKLQASALKLLANQGYDPEMGARPLRRTLQTEVEDKLAELLLKGDLVAGSTLKIGVKAGQLKFDIA

SEQ ID NO: 206 - protein, 392 aa, Streptococcus pneumoniae CDC 3
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNNAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 207 - protein, 392 aa, Streptococcus pneumoniae CDC 11
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVYESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 208 - protein, 392 aa, Streptococcus pneumoniae CDC 24
MKKKILASLLLSTVMVSQVAVLTTAHAETTDDKIAAQDNKISNLTAQQQEAQKQVDQIQEQVSAIQAEQSNLQAENDRLQAESKKLESEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 209 - protein, 392 aa, Streptococcus pneumoniae CDC 25
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEVISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 210 - protein, 392 aa, Streptococcus pneumoniae CDC 27; identical to SEQ ID NO: 208

SEQ ID NO: 211 - protein, 392 aa, Streptococcus pneumoniae CDC 49
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAERATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 212 - protein, 392 aa, Streptococcus pneumoniae CDC 56
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINIVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 213 - protein, 392 aa, Streptococcus pneumoniae CDC 61
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAEDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 214 - protein, 392 aa, Streptococcus pneumoniae CDC 97
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGGQWATSAAAAGFRTGSTPQVGAIACWNDGGYGHVAVVTAVESTTRIQVSESNYAGNRTIGNHRGWFNPTTTSEGFVTYIYAD

SEQ ID NO: 215 - protein, 391 aa, Streptococcus pneumoniae CDC 103
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAESLAAEKATAEGEKASLLEQKAAAEAEARAAAAAEAAYKEKQASQQQSVLASGNTNLTAQVQAVSESAVAPVQAKVRPTYNTDASTYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 216 - protein, 392 aa, Streptococcus pneumoniae CDC 106
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYSGNRTIGNHRGWFNPTTTSEGFVTYIYAD

SEQ ID NO: 217 - protein, 392 aa, Streptococcus pneumoniae CDC 112; identical to SEQ ID NO: 207

SEQ ID NO: 218 - protein, 392 aa, Streptococcus pneumoniae Pj-1280
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRSSQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 219 - protein, 659 aa, Streptococcus pneumoniae CDC 1
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 220 - protein, 659 aa, Streptococcus pneumoniae CDC 2; identical to SEQ ID NO: 219

SEQ ID NO: 221 - protein, 659 aa, Streptococcus pneumoniae CDC 3
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVISELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 222 - protein, 659 aa, Streptococcus pneumoniae CDC 4; identical to SEQ ID NO: 221

SEQ ID NO: 223 - protein, 659 aa, Streptococcus pneumoniae CDC 5
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRTGEKVDLNKTRVKISIYKPKTTSATP

SEQ ID NO: 224 - protein, 659 aa, Streptococcus pneumoniae CDC 8
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKILPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 225 - protein, 659 aa, Streptococcus pneumoniae CDC 11; identical to SEQ ID NO: 219

SEQ ID NO: 226 - protein, 659 aa, Streptococcus pneumoniae CDC 13
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIILTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 227 - protein, 659 aa, Streptococcus pneumoniae CDC 16; identical to SEQ ID NO: 226

SEQ ID NO: 228 - protein, 659 aa, Streptococcus pneumoniae CDC 17
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKTPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPIQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 229 - protein, 659 aa, Streptococcus pneumoniae CDC 18; identical to SEQ ID NO: 219

SEQ ID NO: 230 - protein, 659 aa, Streptococcus pneumoniae CDC 19
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHARGIVHRDLKPQNILLTPDGTAKVTDFGIAVAFAETSLTQTNSMLGSVHYLSPEQARGSKATFQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 231 - protein, 659 aa, Streptococcus pneumoniae CDC 20; identical to SEQ ID NO: 219

SEQ ID NO: 232 - protein, 659 aa, Streptococcus pneumoniae CDC 22
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENSSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 233 - protein, 659 aa, Streptococcus pneumoniae CDC 23; identical to SEQ ID NO: 219

SEQ ID NO: 234 - protein, 659 aa, Streptococcus pneumoniae CDC 25; identical to SEQ ID NO: 219

SEQ ID NO: 235 - protein, 659 aa, Streptococcus pneumoniae CDC 26
MIQIGKIFAGRYRIVKQIGRGGMADVYLAKDLILDGEEVAVKVLRTNYQTDPIAVARFQREARAMADLDHPHIVRITDIGEEDGQQHLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKAQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 236 - protein, 659 aa, Streptococcus pneumoniae CDC 28; identical to SEQ ID NO: 219

SEQ ID NO: 237 - protein, 659 aa, Streptococcus pneumoniae CDC 33
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLILIVGIKEANIEVVEVTTAPAGSVEGMVVEQSPRAGEKVDLNKTRVKISIYKPKTTSATP

SEQ ID NO: 238 - protein, 659 aa, Streptococcus pneumoniae CDC 34; identical to SEQ ID NO: 219

SEQ ID NO: 239 - protein, 659 aa, Streptococcus pneumoniae CDC 37; identical to SEQ ID NO: 232

SEQ ID NO: 240 - protein, 659 aa, Streptococcus pneumoniae CDC 38; identical to SEQ ID NO: 219

SEQ ID NO: 241 - protein, 659 aa, Streptococcus pneumoniae CDC 39; identical to SEQ ID NO: 219

SEQ ID NO: 242 - protein, 659 aa, Streptococcus pneumoniae CDC 41
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKAQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 243 - protein, 659 aa, Streptococcus pneumoniae CDC 42; identical to SEQ ID NO: 219

SEQ ID NO: 244 - protein, 659 aa, Streptococcus pneumoniae CDC 49
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKETLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 245 - protein, 659 aa, Streptococcus pneumoniae CDC 50; identical to SEQ ID NO: 219

SEQ ID NO: 246 - protein, 659 aa, Streptococcus pneumoniae CDC 53; identical to SEQ ID NO: 226

SEQ ID NO: 247 - protein, 659 aa, Streptococcus pneumoniae CDC 55
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVKSDIYAMGIIFYEMLTGHIPYDGDSAVTIALQHFQKPLPSVIAENSSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 248 - protein, 659 aa, Streptococcus pneumoniae CDC 57; identical to SEQ ID NO: 219

SEQ ID NO: 249 - protein, 659 aa, Streptococcus pneumoniae CDC 58
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQAVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIILTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 250 - protein, 659 aa, Streptococcus pneumoniae CDC 60
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLNFDETSKADTKTLPKVSQSTLTSIPKVQAQTEHKSIKNPSQTVTEETYQPQAPKKHRFKMRYLILLANLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 251 - protein, 659 aa, Streptococcus pneumoniae CDC 62; identical to SEQ ID NO: 219

SEQ ID NO: 252 - protein, 659 aa, Streptococcus pneumoniae CDC 65; identical to SEQ ID NO: 219

SEQ ID NO: 253 - protein, 659 aa, Streptococcus pneumoniae CDC 66
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENSSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYALSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 254 - protein, 659 aa, Streptococcus pneumoniae CDC 67; identical to SEQ ID NO: 232

SEQ ID NO: 255 - protein, 659 aa, Streptococcus pneumoniae CDC 68
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEEAYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQNPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 256 - protein, 659 aa, Streptococcus pneumoniae CDC 69
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPKAGEKVDLNKTRVKISIYKPKTTSATP

SEQ ID NO: 257 - protein, 659 aa, Streptococcus pneumoniae CDC 70; identical to SEQ ID NO: 253

SEQ ID NO: 258 - protein, 659 aa, Streptococcus pneumoniae CDC 71; identical to SEQ ID NO: 219

SEQ ID NO: 259 - protein, 659 aa, Streptococcus pneumoniae CDC 74; identical to SEQ ID NO: 242

SEQ ID NO: 260 - protein, 659 aa, Streptococcus pneumoniae CDC 76
MIQIGKIFAGRYRIVKQIGRGGMADVYLAKDLILDGEEVAVKVLRTNYQTDPIAVARFQREARAMAVLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 261 - protein, 659 aa, Streptococcus pneumoniae CDC 77
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYALSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDINKTRVKISIYKPKTTSATP

SEQ ID NO: 262 - protein, 659 aa, Streptococcus pneumoniae CDC 78
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKILPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 263 - protein, 659 aa, Streptococcus pneumoniae CDC 80
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENSSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 264 - protein, 659 aa, Streptococcus pneumoniae CDC 81; identical to SEQ ID NO: 255

SEQ ID NO: 265 - protein, 659 aa, Streptococcus pneumoniae CDC 83; identical to SEQ ID NO: 242

SEQ ID NO: 266 - protein, 659 aa, Streptococcus pneumoniae CDC 84; identical to SEQ ID NO: 244

SEQ ID NO: 267 - protein, 659 aa, Streptococcus pneumoniae CDC 86
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSILSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 268 - protein, 659 aa, Streptococcus pneumoniae CDC 89
MIQIGKIFAGRYRIVKQIGRGGMADVYLAKDLILDGEEVAVKVLRTNYQTDPIAVARFQREARAMADLDHPHIVRITDIGEEDSQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEEAYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQNPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 269 - protein, 658 aa, Streptococcus pneumoniae CDC 93
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTILQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIILTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 270 - protein, 659 aa, Streptococcus pneumoniae CDC 95; identical to SEQ ID NO: 219

SEQ ID NO: 271 - protein, 659 aa, Streptococcus pneumoniae CDC 100; identical to SEQ ID NO: 219

SEQ ID NO: 272 - protein, 659 aa, Streptococcus pneumoniae CDC 103; identical to SEQ ID NO: 219

SEQ ID NO: 273 - protein, 659 aa, Streptococcus pneumoniae CDC 104; identical to SEQ ID NO: 219

SEQ ID NO: 274 - protein, 658 aa, Streptococcus pneumoniae CDC 108
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 275 - protein, 659 aa, Streptococcus pneumoniae CDC 109; identical to SEQ ID NO: 232

SEQ ID NO: 276 - protein, 659 aa, Streptococcus pneumoniae CDC 110; identical to SEQ ID NO: 219

SEQ ID NO: 277 - protein, 659 aa, Streptococcus pneumoniae CDC 111; identical to SEQ ID NO: 232

SEQ ID NO: 278 - protein, 659 aa, Streptococcus pneumoniae CDC 112; identical to SEQ ID NO: 219

SEQ ID NO: 279 - protein, 659 aa, Streptococcus pneumoniae CDC 113; identical to SEQ ID NO: 226

SEQ ID NO: 280 - protein, 659 aa, Streptococcus pneumoniae CDC 115; identical to SEQ ID NO: 219

SEQ ID NO: 281 - protein, 659 aa, Streptococcus pneumoniae Pj-1293; identical to SEQ ID NO: 219

SEQ ID NO: 282 - protein, 644 aa, Streptococcus pneumoniae I-33
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATFQSDIYAMGIIFYEMLTGHIPYDGDSAVTIALQHFQKPLPSVIAENPSVPQALENVVIKATAKKLSDRYQSVSEMYVDLSTSLSYNRRNEPKLVFDDASKADTKTLPKVPQSTLTSIPKAPAQEERPQPKKPTQPVAEPAPAPKPAKKRKFKARYMILLASLLLVAASLVWILSRTPATIAIPDVAGQTVAEAKEALKKSKFEAGEEKSEASDTVAEGRVIRTDPEAGSGRKEGTKVNLIVSSGKQSFQLSNYVGRKYTDVVAELKEKKVPENLIKMEEEESSESEPGTVLRQTPASGSTYDLSKATTITLTVAKKVTSVSMPNYIGSSLEFTKNNLTQIVGVKEANIEVVEVSNAPEGTAEGTVVSQTPRAGELVDLASTRIKLSIYKPKTPPSTSSSNPAQRGNQGSPTSPTQGNQQGNQQGNQQGNNPPTNQPVRRFVCYTPEQCSARDMS

SEQ ID NO: 283 - protein, 659 aa, Streptococcus pneumoniae Pj-1319; identical to SEQ ID NO: 221

SEQ ID NO: 284 - protein, 659 aa, Streptococcus pneumoniae Pj-1321
MSPFRYIFVGFYRIVKQIGRGGMADVYLAKDLILDGEEVAVKVLRTNYHTDPIAVARFQREARAMAHLNHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVIEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 285 - protein, 659 aa, Streptococcus pneumoniae Pj-1241
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRVGEKVDLNKTRVKISIYKPKTTSATP

SEQ ID NO: 286 - protein, 659 aa, Streptococcus pneumoniae Pj-1296
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEVVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKETLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 287 - protein, 659 aa, Streptococcus pneumoniae Pj-1466; identical to SEQ ID NO: 286

SEQ ID NO: 288 - protein, 659 aa, Streptococcus pneumoniae Pj-615; identical to SEQ ID NO: 226

SEQ ID NO: 289 - protein, 659 aa, Streptococcus pneumoniae Pj-1255; identical to SEQ ID NO: 226

SEQ ID NO: 290 - protein, 659 aa, Streptococcus pneumoniae Pj-1410; identical to SEQ ID NO: 219

SEQ ID NO: 291 - protein, 659 aa, Streptococcus pneumoniae Pj-1374
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVIEVTTAPAGSVEGMVVEQSPRAGEKVDLNKTRVKISIYKPKTTSATP

SEQ ID NO: 292 - protein, 659 aa, Streptococcus pneumoniae Pj02-912; identical to SEQ ID NO: 219

SEQ ID NO: 293 - protein, 659 aa, Streptococcus pneumoniae Pj-1364
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISDLKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 294 - protein, 659 aa, Streptococcus pneumoniae Pj-1445
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKAQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 295 - protein, 659 aa, Streptococcus pneumoniae Pj-3; identical to SEQ ID NO: 294

SEQ ID NO: 296 - protein, 659 aa, Streptococcus pneumoniae Pj-2449; identical to SEQ ID NO: 219

SEQ ID NO: 297 - protein, 659 aa, Streptococcus pneumoniae Pj-1874; identical to SEQ ID NO: 219

SEQ ID NO: 298 - protein, 659 aa, Streptococcus pneumoniae Pj-2129; identical to SEQ ID NO: 286

SEQ ID NO: 299 - protein, 659 aa, Streptococcus pneumoniae Pj-2245; identical to SEQ ID NO: 226

SEQ ID NO: 300 - protein, 659 aa, Streptococcus pneumoniae Pj-132; identical to SEQ ID NO: 219

SEQ ID NO: 301 - protein, 659 aa, Streptococcus pneumoniae Pj-1327; identical to SEQ ID NO: 221

SEQ ID NO: 302 - protein, 659 aa, Streptococcus pneumoniae Pj-1498; identical to SEQ ID NO: 219

SEQ ID NO: 303 - protein, 659 aa, Streptococcus pneumoniae Pj-1329; identical to SEQ ID NO: 219

SEQ ID NO: 304 - protein, 659 aa, Streptococcus pneumoniae Pj-1494; identical to SEQ ID NO: 219

SEQ ID NO: 305 - protein, 659 aa, Streptococcus pneumoniae RP-2896; identical to SEQ ID NO: 221

SEQ ID NO: 306 - protein, 659 aa, Streptococcus pneumoniae Pj-362; identical to SEQ ID NO: 219

SEQ ID NO: 307 - protein, 633 aa, Streptococcus pneumoniae Pj-1291
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATFQSDIYAMGIIFYEMLTGHIPYDGDSAVTIALQHFQKPLPSVIAENPSVPQALENVVIKATAKKLSDRYQSVSEMYVDLSTSLSYNRRNEPKLVFDDASKADTKTLPKVPQSTLTSIPKAPAQEERPQPKKPTQPVAEPAPAPKPAKKRKFKARYMILLASLLLVAASLVWILSRTPATIAIPDVAGQTVAEAKEALKKSKFEAGEEKSEASDTVAEGRVIRTDPEAGSGRKEGTKVNLIVSSGKQSFQLSNYVGRKYTDVVAELKEKKVPENLIKMEEEESNESEPGIVLRQTPASGSTYDLSKATTITLTVAKKVTSVSMPNYIGSSLEFTKNNLTQIVGVKEANIEVVEVSTAPEGTAEGTVVNQTPRAGEQVDLASTRIKLSIYKPKTPPSTSSSNPAQRGNQGSPTSPNQGNQQGNQQGNTPSSSHPISIRCANNAGA

SEQ ID NO: 308 - protein, 659 aa, Streptococcus pneumoniae Pj-1248; identical to SEQ ID NO: 219

SEQ ID NO: 309 - protein, 659 aa, Streptococcus pneumoniae Pj-2250
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYALSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 310 - protein, 659 aa, Streptococcus pneumoniae I-59; identical to SEQ ID NO: 226

SEQ ID NO: 311 - protein, 659 aa, Streptococcus pneumoniae Pj-1857
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLLAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 312 - protein, 659 aa, Streptococcus pneumoniae Pj-1287; identical to SEQ ID NO: 294

SEQ ID NO: 313 - protein, 659 aa, Streptococcus pneumoniae Pj-1283; identical to SEQ ID NO: 253

SEQ ID NO: 314 - protein, 659 aa, Streptococcus pneumoniae Pj-1176
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 315 - protein, 659 aa, Streptococcus pneumoniae Pj-1322; identical to SEQ ID NO: 309

SEQ ID NO: 316 - protein, 659 aa, Streptococcus pneumoniae Pj-1369; identical to SEQ ID NO: 226

SEQ ID NO: 317 - protein, 659 aa, Streptococcus pneumoniae Pj-2185; identical to SEQ ID NO: 263

SEQ ID NO: 318 - protein, 309 aa, Streptococcus pneumoniae CDC 5
MKKLGTLLVLFLSAIILVACASGKKDTTSGQKLKVVATNSIIADITKNIAGDKIDLHSIVPIGQDPHEYEPLPEDVKKTSEADLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEAEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 319 - protein, 309 aa, Streptococcus pneumoniae CDC 8
MKKLGTLLVLFLSAIILVACASGKKDTTSGQKLKVVATNSIIADITKNIAGDKIDLHSIVPIGQDPHEYEPLPEDVKKTSEADLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEKEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 320 - protein, 309 aa, Streptococcus pneumoniae CDC 12
MKKLGTLLVLFLSAIILVACASGKKDTTSGQKLKVVATNSIIADITKNIAGDKIDLHSIVPIGQDPHEYEPLPEDVKKTSEANLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEKEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 321 - protein, 309 aa, Streptococcus pneumoniae CDC 33
MKKLGTLLVLFLSAIILVACASGKKATTSGQKLKVVATNSIIADITKNIAGDKIDLHSIVPIGQDPHEYEPLPEDVKKTSEADLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEEEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 322 - protein, 309 aa, Streptococcus pneumoniae CDC 36
MKKLGTLLVLFLSVIALVACASGKKDAASGQKLKVVATNSIIADITKNIAGDKIDLHSIVPVGQDPHEYEPLPEDVKKTSEADLIFYNGINLETGGNAWFTKLVENAKKTENKDYFAVSEGVDVIYLEGKNEKGKEDPHAWLNLENGIIFAKNIAKQLSAKDPSNKEFYEKNLKEYTDKLDKLDKEAKAKFNNIPAEKKLIVTSEGCFKYFSKAYGVPSAYIWEINTEEEGTPEQIKTLVEKLRQTKVPSLFVESSVDDRPMKTVSQDTNIPIYAQIFTDSIAEQGKEGDSYYNMMKYNLDKIAEGLAK

SEQ ID NO: 323 - protein, 309 aa, Streptococcus pneumoniae CDC 38; identical to SEQ ID NO: 321

SEQ ID NO: 324 - protein, 309 aa, Streptococcus pneumoniae CDC 56; identical to SEQ ID NO: 319

SEQ ID NO: 325 - protein, 309 aa, Streptococcus pneumoniae CDC 58; identical to SEQ ID NO: 322

SEQ ID NO: 326 - protein, 309 aa, Streptococcus pneumoniae CDC 66
MKKLGTLLVLFLSAIILVACASGKKDTTSGQKLKVVATNSIIADITKNIAGDKIDLHSIVPIGQDPHEYEPLPEDVKKTSEANLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEEEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 327 - protein, 309 aa, Streptococcus pneumoniae CDC 69
MKKLGTLLVLFLSAIILVACASGKKDTTSGQKLKVVATNSIIADITKNIAGDKIDLHSIVPIGQDPHEYEPLPEDVKKTSEADLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEEEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 328 - protein, 309 aa, Streptococcus pneumoniae CDC 74
MKKLGTLLVLFLSAIILVACASGKKDTTSGQKLKVVATNSIIADITKNIAGDKIDLHSIVPIGQDPHEYEPLPEDVKKTSEADLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEEEGTPEQIKTLVEKLRQTKVPSLFAESSVDDRPMKTVSQDTNIPIYAQIFTDSIAEQGKEGDSYYSMMKYNLDKIAEGLAK

SEQ ID NO: 329 - protein, 309 aa, Streptococcus pneumoniae CDC 96
MKKLGTLLVLFLSAIILVACASGKKDTTSGQKLKVVATNSIIADITKNIAGDKIDLHSIVPIGQDPHEYEPLPEDVKKTSEADLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKNKFNKIPAEKKLIVTSEGAFKYFSKAYGVPSAYIWEINTEEEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 330 - protein, 309 aa, Streptococcus pneumoniae CDC 114
MKKLGTLLVLFLSAIILVACASGKKDTTSGQKLKVVATNSIIADITKNIAGDKIDLHSIVPIGQDPHEYEPLPEDVKKTSEADLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKISAEKKLIVTSEGAFKYFSKAYGVPSAYIWEINTEEEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 331 - protein, 309 aa, Streptococcus pneumoniae CDC 116; identical to SEQ ID NO: 326

SEQ ID NO: 332 - protein, 11 aa, Artificial Sequence
  Synthetic Peptide
KLKLLLLLKLK

SEQ ID NO: 333 - DNA, 26 bp, Artificial Sequence
  Synthetic Oligonucleotide
  variation (1)..(1): n is inosine
  variation (3)..(3): n is inosine
  variation (5)..(5): n is inosine
  variation (7)..(7): n is inosine
  variation (9)..(9): n is inosine
  variation (11)..(11): n is inosine
  variation (13)..(13): n is inosine
  variation (15)..(15): n is inosine
  variation (17)..(17): n is inosine
  variation (19)..(19): n is inosine
  variation (21)..(21): n is inosine
  variation (23)..(23): n is inosine
  variation (25)..(25): n is inosine
ncncncncncncncncncncncncnc

The invention claimed is:

1. An isolated protective polypeptide consisting of the amino acid sequence of SEQ ID NO: 4, or the amino acid sequence with at least 95% sequence identity to the sequence set forth as SEQ ID NO: 4.

2. The protective polypeptide of claim 1, wherein the protective polypeptide consists of an amino acid sequence with at least 97% sequence identity to the sequence set forth as SEQ ID NO: 4.

3. An immunogenic composition comprising at least one protective polypeptide according to claim 1.

4. An isolated protective polypeptide according to claim 1 consisting of the amino acid sequence of SEQ ID NO: 4.

5. An isolated protective polypeptide according to claim 1 with one or more amino acid substitutions at positions L3P, T4K, P17Q, L21I, A23T, or A85S of SEQ ID NO: 4.

6. An isolated protective polypeptide comprising the amino acid sequence of SEQ ID NO: 4 with one or more amino acid substitutions at positions L3P, T4K, P17Q, L21I, A23T, or A85S of SEQ ID NO: 4. A24T, A86S.

7. The immunogenic composition of claim 3 further comprising a pharmaceutically acceptable carrier or excipient.

8. A fusion protein comprising the isolated protective polypeptide thereof according to claim 1.

9. An immunogenic composition comprising the fusion protein according to claim 8.

10. The immunogenic composition of claim 9 further comprising a pharmaceutically acceptable carrier or excipient.

11. A fusion protein comprising the protective polypeptide according to claim 2.

12. An immunogenic composition comprising the fusion protein according to claim 11.

13. The immunogenic composition of claim 12 further comprising a pharmaceutically acceptable carrier or excipient.

14. An immunogenic composition comprising the protective polypeptide according to claim 5.

15. The immunogenic composition of claim 14 further comprising a pharmaceutically acceptable carrier or excipient.

16. An immunogenic composition comprising the protective polypeptide according to claim 6.

17. The immunogenic composition of claim 16 further comprising a pharmaceutically acceptable carrier or excipient.

* * * * *

UNITED STATES PATENT AND TRADEMARK OFFICE
CERTIFICATE OF CORRECTION

PATENT NO. : 8,241,643 B2  
APPLICATION NO. : 12/933020  
DATED : August 14, 2012  
INVENTOR(S) : Andreas Meinke et al.

Page 1 of 1

It is certified that error appears in the above-identified patent and that said Letters Patent is hereby corrected as shown below:

In the Claims:

Claim 6, column 59 at line 41, should read:

6. An isolated protective polypeptide comprising the amino acid sequence of SEQ ID NO: 4 with one or more amino acid substitutions at positions L3P, T4K, P17Q, L21I, A23T, or A85S of SEQ ID NO: 4.

Signed and Sealed this
Sixteenth Day of October, 2012

David J. Kappos
*Director of the United States Patent and Trademark Office*